United States Patent 10,233,495 (METHODS AND COMPOSITIONS FOR SCREENING AND TREATING DEVELOPMENTAL DISORDERS) - sequence listing, part 157

SEQ ID NO: 851 - DNA, 105581 bp, Homo sapiens
gtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaatccaaaggatacattgtaaaatcaatgacctaaaacacttaatataaaataataagaaaaaagagagggaggaggagccaagatggccgaataggaacagctccagtctacagctcccagcgtgagtgacgcagaagacgggtgatttctgcatttccatctgaggtaccgggttcatctcactagggagtgccagacagtgggcgcaggccagtgggtgcatgcaccgtgcgcgagccgaagcagggtgaggcattacctcacctgggaagctcaaggggtcagggagttccctttccaagtcaaagaaaggggtgacggacgcacctggaaaatcgggtcactcccacgcgaatattgcgcttttcagaccggcttaaaaaacggcgcaccacgagactatatcccacacctggatcagagggtcctacccccatggaatctcactgactgctagcacagcagtctgagatcaaactgcaaggcggcagcgaggctgggggaggggcgcccgccatcacccaggcttgcttaggtaaacaaagcagccaggaagctccaactcggtggagctcaccacagctcaaggaggcctgcctgcctctgtaggctccacctctgggggcagggcacagacaaacaaaaagacagcagtaaactctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagcaggggcacactgacacctcacactgcagggtatgccaacagacctgcagctgagggtcctgtctgttagaaggaaaactaacaaacagaaaggacatccacaccaaaaacccatctctacatcaccatcatcaaagaccaaaagtagataaaaccacaaagatggggaaaaaacagaacagaaaaactggaaactctaaaaagcagagcgcctctccacctccaaaggaacgcagttcctcaccagcaacagaaaaaaggtggatggagaatgattttgacgagctgagagaagaaggcttcagacgatcaaattactctgagctacgggaggacattcaaaccaaaggcaaagaagttgaaaactttgaaaaaaatttagaagaatgtataactagaataacaaatacagagaagtgcttaaaggagctgatggagctgaaaaccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatcaacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggacaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagtgctaaacatggaaaggaacaaccagtaccagccgctgcaaaatcatgccaatatgtaaagaccatcgagactaggaagaaactacatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaaaaaggatacccaggaattgaactcagctctgcaccaagtggacctaatagacatccacagaactccccaccccaaatcaacagaatatacattcttctcagcaccacaccacacttattccaaaattgaccacatagttggaagtaaagctctcctcaacaaatgtaaaaaaagagaaataataacaaactgtctctcagaccacagtgcaatcaaactagaactcaggattaacaatctcactcaaagccactcaactacatggaaactgaataacctgctcctgaatgactactgggtacataacgaaatgaaggcagaaataaagatgttctttgaaaccaacgagaacaaagacacaacatagcagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatcctggagctggttttttgaaaggattgacaaaattgatagaccgctagcaagactaataaagaaaaaaagagagaagaatcaaatagacacaataaaaaatgataaaggggatatcaccaccaatcccacagaaatacaaactaccatcagagaatactacaaacatctctatgcaaataaactagaaaatctagaagaaatggataaattcctcgacacatacactctcccaagactaaaccaggaagaagttgaatctctgaatagaccaataacaagagcagaaattgtggcaataatcaatagtttaccaaccaaaaagagtccaggaccaggtggattcacagccgaattctaccagaggtacaaggaggaactggtaccattccttctgaacctattccaatcaatagaaaaagagggaatcctccctaactcattttatgaggccagcatcattctgataccaaagcctggcagagacacaaccaaaaaagagaattttagaccaatagccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagagaaaaatcacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcacaactcctattgaacatagtgttggaagttctggccagggcaatcaggcaggagaaggaaataaagtgtattcaattaggaaaagaggaagtcaaattgtccttgtttgcagatgacatgattgtatatccagaaaacaccatcatctcagcccaaaatctccttcagctgataggcaacttgagcaaagtgtcaggatacaaaatcaatgtgtaaaaatcacaaacattcttatacaccaataacagacaaacagagagccaaatcatgagtgaactcccattcacaattgcttcaaagagaataaaatacctagggatccaacttacaagggatgtgaaggacctcttcaaggagacctacaaaccactgcttaatgaaataaaagaagatacaagcaaagggaagagcattctatgctcataggtaggaagaatcaatatcgtgaaaatggccatactgcccaagataatttatagattaaatgccatccccgtcaagctaccaatgactttcttcacagaactggaaaaaactactttaaagttcatatgtaaccaaaaactagcccacattgccaagtcaatctgaagccaaaagaacaaagctggaggccccatgttacctgacttcaaactataatacaaggctactgtaaccaaaacagcatggtactggtaccgaaacagagatatatatcaatgaaacagaacagagccctcagaaataatgctgcatatctacaaccatctgatcttggacaaacctgacaaaagcaagaaatggggaagggattccctatttaataaatggtgctggaaaaactggctagccatatgtagaaagctgaaactggatcccttccttacaccttatacaaaaatcaattcaagatggattaaagatttaaatgttagacctaaaaccataaaaaccctagaagaaaacctaggcattaccattcaggacataggcgtgggcaaggacttcatgtccaaaacatcaaaagcaatggcaacaaaagccaaaattgacaaatgggatctaattaaactaaagagcttctgcacagcaaaagaaactaccatcagagtgaacaggcaacctacaacatgggagaatattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagctagaatggcaatcattaaaaagtcaggaaactacatgtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaataatgctgctataaggacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaatatatataaattgttgacataattttaatccacagcattatttaaattgtctagttcaagattattttgagaaaacaattaactgtggcaattctaattaaattcccttgatgtgtatattcgaaaaatatataaagcacagattgtaaaataaagaacagcattggaaagtttcaaaatatatatttttaagaaaagctaaaaaaaaaagaaaaaagagaggacaaaatttgtaatatatatatttatatacataaaacacacatatgtgaaaaatatacattgctactatagtccttgttcctgtaactggtcatgagattttagtcaatattcacacctttatttcttacacttctcttttctttgacttcaggctaaacttcagctgacctgggttcatttttactaggataaaccagatcttggttcttgaaattccgaatccttaatggccttaccagttttttgttgttgctttatttcttcatgaaatttttctgctagttatggaaattttaaaaggtcccttgaagaatctccagaattccagatattggtcattcttgcctccattgtggccaataccaatctcccttgtccccagtaccagtcacttcagccccatttttctctgtttgttcattaaaggcatgaagtggccaaattatccagctgacaatttctctaattcaataaagtaattgctgtgtttcttgataaaagcacaacatctgtgtaactaagacataaccacctgaattgaaaaatactgggacagaaagcaaacattctgggttttagggcaataaacccatttacagtaaataataaaaggaggtactgccatgcacatcctttgatttccgtaactgtttatttttgttcttattattatttttttaagccaaggaagaaacaatatcctattttggccaatacatccttcaggagaacctccaacttttcacttcgttgtctctgaattaacacttgaatgttcagtaagacatttcaccagggtatcaaaccagttacttcaaagtagtggggtatgtattagttttctagggctgccataacaaagtaacacaggcctgttggctgacacaacagaacatcattttccagtcagttctgaagtttggaagcccaagatcaaggtgtcccttggtcaggtttttccagaggtctttctcgttggctttgcagaggcctgcttatcactgtgtcctcacatggctctttctctgtggggtcacgtccctggtgctacttgtgtacatccaaattttcacttcttaaaaagacacaaatcagattcagttaaggtctatcctaattttcacttcattacctctcattttcacttaattacctctttaagagcttacctccaaatatacattctgaggtactggaagttagggcttcgacatgtgagttttaagggcacacaatactgataggaaaaaaatattccatgtccttatgtttggttactgtatggctcaggaggccaatttaaggatttgaactgccactaagaatggctatttcagctagggatttaggaactatggaaataaacaggacagtgagtgtacatatccattggggtcactaaaagatggacttgagcagcactaaatctacgaaaacaattttaaagaaatatacctaaaccataaaggtgcagaatggttgaaaagaaagggtaaatagctattgtgcaagtactaactagggaaagatggtatttgtattaatgatcaggtatatgtaccaatagtactgaggaaatttcaatacactaggaatttatgaaaattctaagttcatatcaacctagaagtttatagatttgatgggatctcatggacatatacagctcacttgaaccagagactctagggtacacatttcatttaagtacatacaagttactttaaaaaatactgcatgctatgctatcagcatgctatgctatcagctcaaatttcaaatctgtattacactaactttgtgacataatgcaacagctgatgaaaatgcaaataaagtaaatatctgcagtaattagataagtattttaaataaattaaaatttaaaaacatacattaaaacaccttagttggtaaaacaaatcataatagaaatcaattaattcttagaccttaaagagaacaaccatgctacctgtttaagcttatgcaggcttctgttttgagataaaatgtttaacttgtatctagaagtcctttacatagaaatatcccctagaaaagcagagcatatggtgggggtaaaaggcttgtgtgaggacataagagagatactgaggctgatgtttcgtgcccccttttgtcctttattttattttatttttccaggctggtctcaaaatcctgagctcaggtcgccctcctcggcctcccaaagttctggagttacaggtgtgagccactgcacttggccccttttttccttgagtaaagatgattttcagcagcaaccaggaggaagagagactaaacataacaaatgttggcagtagagtggagcaactaggaagtgccactggcggattctaaatttatataaccagcaaacgacttcagaagaaaattgactaaaattgagcatagagtttccacatcccagaattccactactagtcacaaacatacatatgtatacaaacatccatacaaatgtatgttcaccaaaagagacgaaattcagaaagaattatttgaaatagttataaactcttaataatatgtccatcaaaagtagaatgaataaatagatgatagcatatttatacagcaggaaggggcaatgaaataaaagaacactggccgggcgcggtggctcacgcctgtaattccaacactttgggaggctgagacgggtggatcacaagctcaggagttcgagaccaccctggctaacacagtgaaaccccgtctctactgaaaatacaaaaaattagccgagcgtggtggcgggcgcctgcagtccaagctacttgggagattgaggcaggaggatggcgtgaacccgggaggcagagcttgcagtaagccgagatcgggccactgctctccagtctgggcgaaagagtgggactctgtctaaaaaataaaaaagaacactgctgcacaagatatgcaaaatatcacaaatatattcttaagtaaaagaagactgaccaaaggagtagatactatatgacttaatctgcatagtgttgataataggcaaaattaatctgtggtaacagaagtcaacatagtaattatctttgggatttggaggatgagcgtcttcagggttgttgccatgtacttttgtgtagtttggatggtgatgatatgggaatattccttatttgaaaactcagagtgtaatttatgattgtacatttttctatatgtagattaaactttaatgaaagccttttagaataaaaatatttaagtaattgataaattactgcagcattgaaggaaaatttaaaacattaaatagctacactggaaaaacagaggctgaaatatgatgaattatgtccagcataagaagttggaaaatgaccagtagactgtacaaaaataaagaataggaaaaaataatataacatgtgaacgattgaacaaaatggaaaagaaacatttaatgttgcttttcaatatcaaatgtggacaaatttggaagtttattacatgtgcataacttcttacttaataattctaaaatcagaaaaacctttgtctgaatcctaatttttctcctttgtattggtagagaaacttaaccaattcaaggatacttatgaaattcatggatttatcagagtgtggacattcatgtatttttctgtggaaataaacacatatgacaatgaattgctactccagattctattagaatattacataatatatagtttatagaacgcagaattttttaaaatttgtaaaattctgaattggtgtaaacatccaaaacacatgtacattgtaaaggaaattagtggattttatttgagctgacaactaagataaacaaaatatctattcagactcatattaaaaagcacatagtgttaagaataaaaaatagacattaaagatactctagaaattgaaataatattttttaaaagtcactaaatagaaaattttaagtaaaatggaaaatttacaatatgtaattaaaatatctgattcaataattaaaataatttttgaaaattt

SEQ ID NO: 852 - DNA, 65033 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttcca

SEQ ID NO: 853 - DNA, 82146 bp, Homo sapiens
gtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccaga

SEQ ID NO: 854 - DNA, 107368 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaatccaaaggatacattgtaaaatcaatgacctaaaacacttaatataaaataataagaaaaaagagagggaggaggagccaagatggccgaataggaacagctccagtctacagctcccagcgtgagtgacgcagaagacgggtgatttctgcatttccatctgaggtaccgggttcatctcactagggagtgccagacagtgggcgcaggccagtgggtgcatgcaccgtgcgcgagccgaagcagggtgaggcattacctcacctgggaagctcaaggggtcagggagttccctttccaagtcaaagaaaggggtgacggacgcacctggaaaatcgggtcactcccacgcgaatattgcgcttttcagaccggcttaaaaaacggcgcaccacgagactatatcccacacctggatcagagggtcctacccccatggaatctcactgactgctagcacagcagtctgagatcaaactgcaaggcggcagcgaggctgggggaggggcgcccgccatcacccaggcttgcttaggtaaacaaagcagccaggaagctccaactcggtggagctcaccacagctcaaggaggcctgcctgcctctgtaggctccacctctgggggcagggcacagacaaacaaaaagacagcagtaaactctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagcaggggcacactgacacctcacactgcagggtatgccaacagacctgcagctgagggtcctgtctgttagaaggaaaactaacaaacagaaaggacatccacaccaaaaacccatctctacatcaccatcatcaaagaccaaaagtagataaaaccacaaagatggggaaaaaacagaacagaaaaactggaaactctaaaaagcagagcgcctctccacctccaaaggaacgcagttcctcaccagcaacagaaaaaaggtggatggagaatgattttgacgagctgagagaagaaggcttcagacgatcaaattactctgagctacgggaggacattcaaaccaaaggcaaagaagttgaaaactttgaaaaaaatttagaagaatgtataactagaataacaaatacagagaagtgcttaaaggagctgatggagctgaaaaccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatcaacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggacaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagtgctaaacatggaaaggaacaaccagtaccagccgctgcaaaatcatgccaatatgtaaagaccatcgagactaggaagaaactacatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaaaaaggatacccaggaattgaactcagctctgcaccaagtggacctaatagacatccacagaactccccaccccaaatcaacagaatatacattcttctcagcaccacaccacacttattccaaaattgaccacatagttggaagtaaagctctcctcaacaaatgtaaaaaaagagaaataataacaaactgtctctcagaccacagtgcaatcaaactagaactcaggattaacaatctcactcaaagccactcaactacatggaaactgaataacctgctcctgaatgactactgggtacataacgaaatgaaggcagaaataaagatgttctttgaaaccaacgagaacaaagacacaacatagcagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatcctggagctggttttttgaaaggattgacaaaattgatagaccgctagcaagactaataaagaaaaaaagagagaagaatcaaatagacacaataaaaaatgataaaggggatatcaccaccaatcccacagaaatacaaactaccatcagagaatactacaaacatctctatgcaaataaactagaaaatctagaagaaatggataaattcctcgacacatacactctcccaagactaaaccaggaagaagttgaatctctgaatagaccaataacaagagcagaaattgtggcaataatcaatagtttaccaaccaaaaagagtccaggaccaggtggattcacagccgaattctaccagaggtacaaggaggaactggtaccattccttctgaacctattccaatcaatagaaaaagagggaatcctccctaactcattttatgaggccagcatcattctgataccaaagcctggcagagacacaaccaaaaaagagaattttagaccaatagccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagagaaaaatcacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcacaactcctattgaacatagtgttggaagttctggccagggcaatcaggcaggagaaggaaataaagtgtattcaattaggaaaagaggaagtcaaattgtccttgtttgcagatgacatgattgtatatccagaaaacaccatcatctcagcccaaaatctccttcagctgataggcaacttgagcaaagtgtcaggatacaaaatcaatgtgtaaaaatcacaaacattcttatacaccaataacagacaaacagagagccaaatcatgagtgaactcccattcacaattgcttcaaagagaataaaatacctagggatccaacttacaagggatgtgaaggacctcttcaaggagacctacaaaccactgcttaatgaaataaaagaagatacaagcaaagggaagagcattctatgctcataggtaggaagaatcaatatcgtgaaaatggccatactgcccaagataatttatagattaaatgccatccccgtcaagctaccaatgactttcttcacagaactggaaaaaactactttaaagttcatatgtaaccaaaaactagcccacattgccaagtcaatctgaagccaaaagaacaaagctggaggccccatgttacctgacttcaaactataatacaaggctactgtaaccaaaacagcatggtactggtaccgaaacagagatatatatcaatgaaacagaacagagccctcagaaataatgctgcatatctacaaccatctgatcttggacaaacctgacaaaagcaagaaatggggaagggattccctatttaataaatggtgctggaaaaactggctagccatatgtagaaagctgaaactggatcccttccttacaccttatacaaaaatcaattcaagatggattaaagatttaaatgttagacctaaaaccataaaaaccctagaagaaaacctaggcattaccattcaggacataggcgtgggcaaggacttcatgtccaaaacatcaaaagcaatggcaacaaaagccaaaattgacaaatgggatctaattaaactaaagagcttctgcacagcaaaagaaactaccatcagagtgaacaggcaacctacaacatgggagaatattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagctagaatggcaatcattaaaaagtcaggaaactacatgtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaataatgctgctataaggacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaatatatataaattgttgacataattttaatccacagcattatttaaattgtctagttcaagattattttgagaaaacaattaactgtggcaattctaattaaattcccttgatgtgtatattcgaaaaatatataaagcacagattgtaaaataaagaacagcattggaaagtttcaaaatatatatttttaagaaaagctaaaaaaaaaagaaaaaagagaggacaaaatttgtaatatatatatttatatacataaaacacacatatgtgaaaaatatacattgctactatagtccttgttcctgtaactggtcatgagattttagtcaatattcacacctttatttcttacacttctcttttctttgacttcaggctaaacttcagctgacctgggttcatttttactaggataaaccagatcttggttcttgaaattccgaatccttaatggccttaccagttttttgttgttgctttatttcttcatgaaatttttctgctagttatggaaattttaaaaggtcccttgaagaatctccagaattccagatattggtcattcttgcctccattgtggccaataccaatctcccttgtccccagtaccagtcacttcagccccatttttctctgtttgttcattaaaggcatgaagtggccaaattatccagctgacaatttctctaattcaataaagtaattgctgtgtttcttgataaaagcacaacatctgtgtaactaagacataaccacctgaattgaaaaatactgggacagaaagcaaacattctgggttttagggcaataaacccatttacagtaaataataaaaggaggtactgccatgcacatcctttgatttccgtaactgtttatttttgttcttattattatttttttaagccaaggaagaaacaatatcctattttggccaatacatccttcaggagaacctccaacttttcacttcgttgtctctgaattaacacttgaatgttcagtaagacatttcaccagggtatcaaaccagttacttcaaagtagtggggtatgtattagttttctagggctgccataacaaagtaacacaggcctgttggctgacacaacagaacatcattttccagtcagttctgaagtttggaagcccaagatcaaggtgtcccttggtcaggtttttccagaggtctttctcgttggctttgcagaggcctgcttatcactgtgtcctcacatggctctttctctgtggggtcacgtccctggtgctacttgtgtacatccaaattttcacttcttaaaaagacacaaatcagattcagttaaggtctatcctaattttcacttcattacctctcattttcacttaattacctctttaagagcttacctccaaatatacattctgaggtactggaagttagggcttcgacatgtgagttttaagggcacacaatactgataggaaaaaaatattccatgtccttatgtttggttactgtatggctcaggaggccaatttaaggatttgaactgccactaagaatggctatttcagctagggatttaggaactatggaaataaacaggacagtgagtgtacatatccattggggtcactaaaagatggacttgagcagcactaaatctacgaaaacaattttaaagaaatatacctaaaccataaaggtgcagaatggttgaaaagaaagggtaaatagctattgtgcaagtactaactagggaaagatggtatttgtattaatgatcaggtatatgtaccaatagtactgaggaaatttcaatacactaggaatttatgaaaattctaagttcatatcaacctagaagtttatagatttgatgggatctcatggacatatacagctcacttgaaccagagactctagggtacacatttcatttaagtacatacaagttactttaaaaaatactgcatgctatgctatcagcatgctatgctatcagctcaaatttcaaatctgtattacactaactttgtgacataatgcaacagctgatgaaaatgcaaataaagtaaatatctgcagtaattagataagtattttaaataaattaaaatttaaaaacatacattaaaacaccttagttggtaaaacaaatcataatagaaatcaattaattcttagaccttaaagagaacaaccatgctacctgtttaagcttatgcaggcttctgttttgagataaaatgtttaacttgtatctagaagtcctttacatagaaatatcccctagaaaagcagagcatatggtgggggtaaaaggcttgtgtgaggacataagagagatactgaggctgatgtttcgtgcccccttttgtcctttattttattttatttttccaggctggtctcaaaatcctgagctcaggtcgccctcctcggcctcccaaagttctggagttacaggtgtgagccactgcacttggccccttttttccttgagtaaagatgattttcagcagcaaccaggaggaagagagactaaacataacaaatgttggcagtagagtggagcaactaggaagtgccactggcggattctaaatttatataaccagcaaacgacttcagaagaaaattgactaaaattgagcatagagtttccacatcccagaattccactactagtcacaaacatacatatgtatacaaacatccatacaaatgtatgttcaccaaaagagacgaaattcagaaagaattatttgaaatagttataaactcttaataatatgtccatcaaaagtagaatgaataaatagatgatagcatatttatacagcaggaaggggcaatgaaataaaagaacactggccgggcgcggtggctcacgcctgtaattccaacactttgggaggctgagacgggtggatcacaagctcaggagttcgagaccaccctggctaacacagtgaaaccccgtctctactgaaaatacaaaaaattagccgagcgtggtggcgggcgcctgcagtccaagctacttgggagattgaggcaggaggatggcgtgaacccgggaggcagagcttgcagtaagccgagatcgggccactgctctccagtctgggcgaaagagtgggactctgtctaaaaaataaaaaagaacactgctgcacaagatatgcaaaatatcacaaatatattcttaagtaaaagaagactgaccaaaggagtagatactatatgacttaatctgcatagtgttgataataggcaaaattaatctgtggtaacagaagtcaacatagtaattatctttgggatttggaggatgagcgtcttcagggttgttgccatgtacttttgtgtagtttggatggtgatgatatgggaatattccttatttgaaaactcagagtgtaatttatgattgtacatttttctatatgtagattaaactttaatgaaagccttttagaataaaaatatttaagtaattgataaattactgcagcattgaaggaaaatttaaaacattaaatagctacactggaaaaacagaggctgaaatatgatgaattatgtccagcataagaagttggaaaatgaccagtagactgtacaaaaataaagaataggaaaaaataatataacatgtgaacgattgaacaaaatggaaaagaaacatttaatgttgcttttcaatatcaaatgtggacaaatttggaagtttattacatgtgcataacttcttacttaataattctaaaatcagaaaaacctttgtctgaatcctaatttttctcctttgtattggtagagaaacttaaccaattcaaggatacttatgaaattcatggatttatcagagtgtggacattcatgtatttttctgtggaaataaacacatatgacaatgaattgctactccagattctattagaatattacataatatatagtttatagaacgcagaattttttaaaatttgtaaaattctgaattggtgtaaacatccaaaacacatgtacattgtaaaggaaattagtggattttatttgagctgacaactaagataaacaaaatatctattcagactcatattaaaaagcacatagtgttaagaataaaaaatagacattaaagatactctagaaattgaaataatattttttaaaagtcactaaatagaaaattttaagtaaaatggaaaatttacaatatgtaattaaaatatctgattcaataattaaaataatttttgaaaattt

SEQ ID NO: 855 - DNA, 89833 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttctt

SEQ ID NO: 856 - DNA, 83933 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccaga

SEQ ID NO: 857 - DNA, 89302 bp, Homo sapiens
gtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataa

SEQ ID NO: 858 - DNA, 95222 bp, Homo sapiens
gtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaat

SEQ ID NO: 859 - DNA, 108652 bp, Homo sapiens
gtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaatccaaaggatacattgtaaaatcaatgacctaaaacacttaatataaaataataagaaaaaagagagggaggaggagccaagatggccgaataggaacagctccagtctacagctcccagcgtgagtgacgcagaagacgggtgatttctgcatttccatctgaggtaccgggttcatctcactagggagtgccagacagtgggcgcaggccagtgggtgcatgcaccgtgcgcgagccgaagcagggtgaggcattacctcacctgggaagctcaaggggtcagggagttccctttccaagtcaaagaaaggggtgacggacgcacctggaaaatcgggtcactcccacgcgaatattgcgcttttcagaccggcttaaaaaacggcgcaccacgagactatatcccacacctggatcagagggtcctacccccatggaatctcactgactgctagcacagcagtctgagatcaaactgcaaggcggcagcgaggctgggggaggggcgcccgccatcacccaggcttgcttaggtaaacaaagcagccaggaagctccaactcggtggagctcaccacagctcaaggaggcctgcctgcctctgtaggctccacctctgggggcagggcacagacaaacaaaaagacagcagtaaactctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagcaggggcacactgacacctcacactgcagggtatgccaacagacctgcagctgagggtcctgtctgttagaaggaaaactaacaaacagaaaggacatccacaccaaaaacccatctctacatcaccatcatcaaagaccaaaagtagataaaaccacaaagatggggaaaaaacagaacagaaaaactggaaactctaaaaagcagagcgcctctccacctccaaaggaacgcagttcctcaccagcaacagaaaaaaggtggatggagaatgattttgacgagctgagagaagaaggcttcagacgatcaaattactctgagctacgggaggacattcaaaccaaaggcaaagaagttgaaaactttgaaaaaaatttagaagaatgtataactagaataacaaatacagagaagtgcttaaaggagctgatggagctgaaaaccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatcaacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggacaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagtgctaaacatggaaaggaacaaccagtaccagccgctgcaaaatcatgccaatatgtaaagaccatcgagactaggaagaaactacatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaaaaaggatacccaggaattgaactcagctctgcaccaagtggacctaatagacatccacagaactccccaccccaaatcaacagaatatacattcttctcagcaccacaccacacttattccaaaattgaccacatagttggaagtaaagctctcctcaacaaatgtaaaaaaagagaaataataacaaactgtctctcagaccacagtgcaatcaaactagaactcaggattaacaatctcactcaaagccactcaactacatggaaactgaataacctgctcctgaatgactactgggtacataacgaaatgaaggcagaaataaagatgttctttgaaaccaacgagaacaaagacacaacatagcagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatcctggagctggttttttgaaaggattgacaaaattgatagaccgctagcaagactaataaagaaaaaaagagagaagaatcaaatagacacaataaaaaatgataaaggggatatcaccaccaatcccacagaaatacaaactaccatcagagaatactacaaacatctctatgcaaataaactagaaaatctagaagaaatggataaattcctcgacacatacactctcccaagactaaaccaggaagaagttgaatctctgaatagaccaataacaagagcagaaattgtggcaataatcaatagtttaccaaccaaaaagagtccaggaccaggtggattcacagccgaattctaccagaggtacaaggaggaactggtaccattccttctgaacctattccaatcaatagaaaaagagggaatcctccctaactcattttatgaggccagcatcattctgataccaaagcctggcagagacacaaccaaaaaagagaattttagaccaatagccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagagaaaaatcacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcacaactcctattgaacatagtgttggaagttctggccagggcaatcaggcaggagaaggaaataaagtgtattcaattaggaaaagaggaagtcaaattgtccttgtttgcagatgacatgattgtatatccagaaaacaccatcatctcagcccaaaatctccttcagctgataggcaacttgagcaaagtgtcaggatacaaaatcaatgtgtaaaaatcacaaacattcttatacaccaataacagacaaacagagagccaaatcatgagtgaactcccattcacaattgcttcaaagagaataaaatacctagggatccaacttacaagggatgtgaaggacctcttcaaggagacctacaaaccactgcttaatgaaataaaagaagatacaagcaaagggaagagcattctatgctcataggtaggaagaatcaatatcgtgaaaatggccatactgcccaagataatttatagattaaatgccatccccgtcaagctaccaatgactttcttcacagaactggaaaaaactactttaaagttcatatgtaaccaaaaactagcccacattgccaagtcaatctgaagccaaaagaacaaagctggaggccccatgttacctgacttcaaactataatacaaggctactgtaaccaaaacagcatggtactggtaccgaaacagagatatatatcaatgaaacagaacagagccctcagaaataatgctgcatatctacaaccatctgatcttggacaaacctgacaaaagcaagaaatggggaagggattccctatttaataaatggtgctggaaaaactggctagccatatgtagaaagctgaaactggatcccttccttacaccttatacaaaaatcaattcaagatggattaaagatttaaatgttagacctaaaaccataaaaaccctagaagaaaacctaggcattaccattcaggacataggcgtgggcaaggacttcatgtccaaaacatcaaaagcaatggcaacaaaagccaaaattgacaaatgggatctaattaaactaaagagcttctgcacagcaaaagaaactaccatcagagtgaacaggcaacctacaacatgggagaatattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagctagaatggcaatcattaaaaagtcaggaaactacatgtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaataatgctgctataaggacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaatatatataaattgttgacataattttaatccacagcattatttaaattgtctagttcaagattattttgagaaaacaattaactgtggcaattctaattaaattcccttgatgtgtatattcgaaaaatatataaagcacagattgtaaaataaagaacagcattggaaagtttcaaaatatatatttttaagaaaagctaaaaaaaaaagaaaaaagagaggacaaaatttgtaatatatatatttatatacataaaacacacatatgtgaaaaatatacattgctactatagtccttgttcctgtaactggtcatgagattttagtcaatattcacacctttatttcttacacttctcttttctttgacttcaggctaaacttcagctgacctgggttcatttttactaggataaaccagatcttggttcttgaaattccgaatccttaatggccttaccagttttttgttgttgctttatttcttcatgaaatttttctgctagttatggaaattttaaaaggtcccttgaagaatctccagaattccagatattggtcattcttgcctccattgtggccaataccaatctcccttgtccccagtaccagtcacttcagccccatttttctctgtttgttcattaaaggcatgaagtggccaaattatccagctgacaatttctctaattcaataaagtaattgctgtgtttcttgataaaagcacaacatctgtgtaactaagacataaccacctgaattgaaaaatactgggacagaaagcaaacattctgggttttagggcaataaacccatttacagtaaataataaaaggaggtactgccatgcacatcctttgatttccgtaactgtttatttttgttcttattattatttttttaagccaaggaagaaacaatatcctattttggccaatacatccttcaggagaacctccaacttttcacttcgttgtctctgaattaacacttgaatgttcagtaagacatttcaccagggtatcaaaccagttacttcaaagtagtggggtatgtattagttttctagggctgccataacaaagtaacacaggcctgttggctgacacaacagaacatcattttccagtcagttctgaagtttggaagcccaagatcaaggtgtcccttggtcaggtttttccagaggtctttctcgttggctttgcagaggcctgcttatcactgtgtcctcacatggctctttctctgtggggtcacgtccctggtgctacttgtgtacatccaaattttcacttcttaaaaagacacaaatcagattcagttaaggtctatcctaattttcacttcattacctctcattttcacttaattacctctttaagagcttacctccaaatatacattctgaggtactggaagttagggcttcgacatgtgagttttaagggcacacaatactgataggaaaaaaatattccatgtccttatgtttggttactgtatggctcaggaggccaatttaaggatttgaactgccactaagaatggctatttcagctagggatttaggaactatggaaataaacaggacagtgagtgtacatatccattggggtcactaaaagatggacttgagcagcactaaatctacgaaaacaattttaaagaaatatacctaaaccataaaggtgcagaatggttgaaaagaaagggtaaatagctattgtgcaagtactaactagggaaagatggtatttgtattaatgatcaggtatatgtaccaatagtactgaggaaatttcaatacactaggaatttatgaaaattctaagttcatatcaacctagaagtttatagatttgatgggatctcatggacatatacagctcacttgaaccagagactctagggtacacatttcatttaagtacatacaagttactttaaaaaatactgcatgctatgctatcagcatgctatgctatcagctcaaatttcaaatctgtattacactaactttgtgacataatgcaacagctgatgaaaatgcaaataaagtaaatatctgcagtaattagataagtattttaaataaattaaaatttaaaaacatacattaaaacaccttagttggtaaaacaaatcataatagaaatcaattaattcttagaccttaaagagaacaaccatgctacctgtttaagcttatgcaggcttctgttttgagataaaatgtttaacttgtatctagaagtcctttacatagaaatatcccctagaaaagcagagcatatggtgggggtaaaaggcttgtgtgaggacataagagagatactgaggctgatgtttcgtgcccccttttgtcctttattttattttatttttccaggctggtctcaaaatcctgagctcaggtcgccctcctcggcctcccaaagttctggagttacaggtgtgagccactgcacttggccccttttttccttgagtaaagatgattttcagcagcaaccaggaggaagagagactaaacataacaaatgttggcagtagagtggagcaactaggaagtgccactggcggattctaaatttatataaccagcaaacgacttcagaagaaaattgactaaaattgagcatagagtttccacatcccagaattccactactagtcacaaacatacatatgtatacaaacatccatacaaatgtatgttcaccaaaagagacgaaattcagaaagaattatttgaaatagttataaactcttaataatatgtccatcaaaagtagaatgaataaatagatgatagcatatttatacagcaggaaggggcaatgaaataaaagaacactggccgggcgcggtggctcacgcctgtaattccaacactttgggaggctgagacgggtggatcacaagctcaggagttcgagaccaccctggctaacacagtgaaaccccgtctctactgaaaatacaaaaaattagccgagcgtggtggcgggcgcctgcagtccaagctacttgggagattgaggcaggaggatggcgtgaacccgggaggcagagcttgcagtaagccgagatcgggccactgctctccagtctgggcgaaagagtgggactctgtctaaaaaataaaaaagaacactgctgcacaagatatgcaaaatatcacaaatatattcttaagtaaaagaagactgaccaaaggagtagatactatatgacttaatctgcatagtgttgataataggcaaaattaatctgtggtaacagaagtcaacatagtaattatctttgggatttggaggatgagcgtcttcagggttgttgccatgtacttttgtgtagtttggatggtgatgatatgggaatattccttatttgaaaactcagagtgtaatttatgattgtacatttttctatatgtagattaaactttaatgaaagccttttagaataaaaatatttaagtaattgataaattactgcagcattgaaggaaaatttaaaacattaaatagctacactggaaaaacagaggctgaaatatgatgaattatgtccagcataagaagttggaaaatgaccagtagactgtacaaaaataaagaataggaaaaaataatataacatgtgaacgattgaacaaaatggaaaagaaacatttaatgttgcttttcaatatcaaatgtggacaaatttggaagtttattacatgtgcataacttcttacttaataattctaaaatcagaaaaacctttgtctgaatcctaatttttctcctttgtattggtagagaaacttaaccaattcaaggatacttatgaaattcatggatttatcagagtgtggacattcatgtatttttctgtggaaataaacacatatgacaatgaattgctactccagattctattagaatattacataatatatagtttatagaacgcagaattttttaaaatttgtaaaattctgaattggtgtaaacatccaaaacacatgtacattgtaaaggaaattagtggattttatttgagctgacaactaagataaacaaaatatctattcagactcatattaaaaagcacatagtgttaagaataaaaaatagacattaaagatactctagaaattgaaataatattttttaaaagtcactaaatagaaaattttaagtaaaatggaaaatttacaatatgtaattaaaatatctgattcaataattaaaataatttttgaaaatttcttcattctcttagactaaaacgtattagatccttattataaaacactaggcccaagaaattctatagaaagtttcagtaaacattcaaggaagtgataattccaatcctgtacaaactccttcagaaaataaggaagaaataggccatttattttacaaaagtagtatacacttaacatcataatcaagctagaaaggggattagaacccaatttcatgcatgggtatgaatgtgagtcttaaccaaaatattagtaaagtgaatccagcaatatatgaaaaaccctaacgcttcacatctgataagtttactaagagcacaaagtctttttctacattgtatatccactcatacattaaaggagaaaaaattatgtaatcccctcaaaagattttattaaaaatatgatagaaattcttaactaatgcttacaagaaaatttattacatttggtataggttgtataaaacaaataaatgagcatagtatttaattttgagaggttgaaactattctactcaacagaaacacattaagaatgtctattatctttgttctgtttatcattgcactggaggtcctagcaagtacactataataagcagaagaaataaaagcatcaagaattgaaaaaaatatataaaaatagtattcaaaaattatgtgcatatttatgtagaaaaagcatctggatatataatgaatataagggattattcgttgtattcagaaatatgaccagtaacaaaagccaaattaatttccaaatgcaagcagcaacaggaaaataaaactttaagtaaacacaacttatcatagaaaacacataagtgagtgagaatatgtggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattattggacatttgggttggttccaagtctttgctattgtgaatagtgctgcaataaacatacatgtgcatctgtctttatagcagcatgatttataatcctttgggtatatacccagtaatgggatggctgggtcaaatggtatttctagttctagatccttgaagaatcgccacactgacttccacaatggttgaactagtttacagtcccaccaacagtgtaaaagtgctcctatttctccacatcctctccagcacctgtagtttcctgactttttaatgattgccattctaacttgtgtgagatggtatctccttgtggttttggtttgcatttctctgatggccagtgatcatgagcattttttcatgtttcttttggcttcataaatatcttcttttgagaagtgtctgttcatatccttcacccacttgttgatggtgttgtttgtttttttcttgtaaatttgtttgagttcattgtagattctggatattagccctttgtcagatgagtacattgcaaaaattttctcccattctgtaggttgcctgttccctctgatggtagtttcttttgctgtgcagaagctctttagtttaattagatcccatttgttaattttggcttttgttgccattgcttttagtgttttagacacgaagtccttctaatggagctcactgagcatattctaaaatatatgagatatattaaaggacattaaagccatgatactcccaaacagtaaaaatgggggggggattggatgcaataaatttgaggaatttcagggctgattaaggaaaactatgtgagcatgaatagatggtagcatgcaatgagctttattggaagctcagacagatttgcaagtgaggaaaattccctcacagcatgagaccatccatcagcactgcctagaatgggaggaaagcaagggaactgcaaggggagaggataagagaagaggtgtacaggcataagtaatatcaatcagcagcaaggtgaggagtctgtgggtctgagagctcgggggggaagtagtgacttgaggtctcgtaaccacaaggttcacctttttcatggctagctgatgttgggtgcagtttcatgaagtatgcaaagcaggctagctctaaatgactaaaaatctgcttttatggtctatgtttactaccattggatatataaaaagttgagttatggtgctgatggacttttgagctaatggttctcactctgctgtgaagaagttaacgacaaagaagaaaaatacggatgctatctttggctcatttatgcaacattggcctttgcagacaacaccatttattatatatatatgcattaaacagtgtcatattgcttcacagggagttaaaaattatgcagtgtaaaatgcatattaaaatcccagtgaaataagattttgccgtccccagtactgcaaaatttaaacttataaatgtccatgttttagcaaggatgttaaattatgagaactctcaagcactgcttgtgaatgtcaatttttgcaatctgtgggatagggagtaagtattaagttgaatgtattcattctctgtaattcagcaattcaagtatcatttacgctcatcatggatattgttacacatttctacctggagccaattctaagaatgttcacaacagttttgtctgaattagcagataaaaacaaaacaagacaaatcagttgttcaagaatagaggaatagataaataaattgcaggttatgcatagcacaaaacactaaagaaaaaaatgaactaaatgtttttatcctaatatgaatctccaaaaatataattttgagagaagaaaactatttacagaagattcaagttcaaaagcaggtaaaattagataatatattgttttagaactatatctatatctacatattaataggatatattcatattttatatatcaatatttatatatttacattaatactactgatataaaaataaacaggatatttataaatatgtaattcaatgagtagttacttctgaatgggaggaagggcatagttt

SEQ ID NO: 860 - DNA, 97009 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaat

SEQ ID NO: 861 - DNA, 91089 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataa

SEQ ID NO: 862 - DNA, 110439 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaatccaaaggatacattgtaaaatcaatgacctaaaacacttaatataaaataataagaaaaaagagagggaggaggagccaagatggccgaataggaacagctccagtctacagctcccagcgtgagtgacgcagaagacgggtgatttctgcatttccatctgaggtaccgggttcatctcactagggagtgccagacagtgggcgcaggccagtgggtgcatgcaccgtgcgcgagccgaagcagggtgaggcattacctcacctgggaagctcaaggggtcagggagttccctttccaagtcaaagaaaggggtgacggacgcacctggaaaatcgggtcactcccacgcgaatattgcgcttttcagaccggcttaaaaaacggcgcaccacgagactatatcccacacctggatcagagggtcctacccccatggaatctcactgactgctagcacagcagtctgagatcaaactgcaaggcggcagcgaggctgggggaggggcgcccgccatcacccaggcttgcttaggtaaacaaagcagccaggaagctccaactcggtggagctcaccacagctcaaggaggcctgcctgcctctgtaggctccacctctgggggcagggcacagacaaacaaaaagacagcagtaaactctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagcaggggcacactgacacctcacactgcagggtatgccaacagacctgcagctgagggtcctgtctgttagaaggaaaactaacaaacagaaaggacatccacaccaaaaacccatctctacatcaccatcatcaaagaccaaaagtagataaaaccacaaagatggggaaaaaacagaacagaaaaactggaaactctaaaaagcagagcgcctctccacctccaaaggaacgcagttcctcaccagcaacagaaaaaaggtggatggagaatgattttgacgagctgagagaagaaggcttcagacgatcaaattactctgagctacgggaggacattcaaaccaaaggcaaagaagttgaaaactttgaaaaaaatttagaagaatgtataactagaataacaaatacagagaagtgcttaaaggagctgatggagctgaaaaccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatcaacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggacaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagtgctaaacatggaaaggaacaaccagtaccagccgctgcaaaatcatgccaatatgtaaagaccatcgagactaggaagaaactacatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaaaaaggatacccaggaattgaactcagctctgcaccaagtggacctaatagacatccacagaactccccaccccaaatcaacagaatatacattcttctcagcaccacaccacacttattccaaaattgaccacatagttggaagtaaagctctcctcaacaaatgtaaaaaaagagaaataataacaaactgtctctcagaccacagtgcaatcaaactagaactcaggattaacaatctcactcaaagccactcaactacatggaaactgaataacctgctcctgaatgactactgggtacataacgaaatgaaggcagaaataaagatgttctttgaaaccaacgagaacaaagacacaacatagcagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatcctggagctggttttttgaaaggattgacaaaattgatagaccgctagcaagactaataaagaaaaaaagagagaagaatcaaatagacacaataaaaaatgataaaggggatatcaccaccaatcccacagaaatacaaactaccatcagagaatactacaaacatctctatgcaaataaactagaaaatctagaagaaatggataaattcctcgacacatacactctcccaagactaaaccaggaagaagttgaatctctgaatagaccaataacaagagcagaaattgtggcaataatcaatagtttaccaaccaaaaagagtccaggaccaggtggattcacagccgaattctaccagaggtacaaggaggaactggtaccattccttctgaacctattccaatcaatagaaaaagagggaatcctccctaactcattttatgaggccagcatcattctgataccaaagcctggcagagacacaaccaaaaaagagaattttagaccaatagccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagagaaaaatcacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcacaactcctattgaacatagtgttggaagttctggccagggcaatcaggcaggagaaggaaataaagtgtattcaattaggaaaagaggaagtcaaattgtccttgtttgcagatgacatgattgtatatccagaaaacaccatcatctcagcccaaaatctccttcagctgataggcaacttgagcaaagtgtcaggatacaaaatcaatgtgtaaaaatcacaaacattcttatacaccaataacagacaaacagagagccaaatcatgagtgaactcccattcacaattgcttcaaagagaataaaatacctagggatccaacttacaagggatgtgaaggacctcttcaaggagacctacaaaccactgcttaatgaaataaaagaagatacaagcaaagggaagagcattctatgctcataggtaggaagaatcaatatcgtgaaaatggccatactgcccaagataatttatagattaaatgccatccccgtcaagctaccaatgactttcttcacagaactggaaaaaactactttaaagttcatatgtaaccaaaaactagcccacattgccaagtcaatctgaagccaaaagaacaaagctggaggccccatgttacctgacttcaaactataatacaaggctactgtaaccaaaacagcatggtactggtaccgaaacagagatatatatcaatgaaacagaacagagccctcagaaataatgctgcatatctacaaccatctgatcttggacaaacctgacaaaagcaagaaatggggaagggattccctatttaataaatggtgctggaaaaactggctagccatatgtagaaagctgaaactggatcccttccttacaccttatacaaaaatcaattcaagatggattaaagatttaaatgttagacctaaaaccataaaaaccctagaagaaaacctaggcattaccattcaggacataggcgtgggcaaggacttcatgtccaaaacatcaaaagcaatggcaacaaaagccaaaattgacaaatgggatctaattaaactaaagagcttctgcacagcaaaagaaactaccatcagagtgaacaggcaacctacaacatgggagaatattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagctagaatggcaatcattaaaaagtcaggaaactacatgtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaataatgctgctataaggacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaatatatataaattgttgacataattttaatccacagcattatttaaattgtctagttcaagattattttgagaaaacaattaactgtggcaattctaattaaattcccttgatgtgtatattcgaaaaatatataaagcacagattgtaaaataaagaacagcattggaaagtttcaaaatatatatttttaagaaaagctaaaaaaaaaagaaaaaagagaggacaaaatttgtaatatatatatttatatacataaaacacacatatgtgaaaaatatacattgctactatagtccttgttcctgtaactggtcatgagattttagtcaatattcacacctttatttcttacacttctcttttctttgacttcaggctaaacttcagctgacctgggttcatttttactaggataaaccagatcttggttcttgaaattccgaatccttaatggccttaccagttttttgttgttgctttatttcttcatgaaatttttctgctagttatggaaattttaaaaggtcccttgaagaatctccagaattccagatattggtcattcttgcctccattgtggccaataccaatctcccttgtccccagtaccagtcacttcagccccatttttctctgtttgttcattaaaggcatgaagtggccaaattatccagctgacaatttctctaattcaataaagtaattgctgtgtttcttgataaaagcacaacatctgtgtaactaagacataaccacctgaattgaaaaatactgggacagaaagcaaacattctgggttttagggcaataaacccatttacagtaaataataaaaggaggtactgccatgcacatcctttgatttccgtaactgtttatttttgttcttattattatttttttaagccaaggaagaaacaatatcctattttggccaatacatccttcaggagaacctccaacttttcacttcgttgtctctgaattaacacttgaatgttcagtaagacatttcaccagggtatcaaaccagttacttcaaagtagtggggtatgtattagttttctagggctgccataacaaagtaacacaggcctgttggctgacacaacagaacatcattttccagtcagttctgaagtttggaagcccaagatcaaggtgtcccttggtcaggtttttccagaggtctttctcgttggctttgcagaggcctgcttatcactgtgtcctcacatggctctttctctgtggggtcacgtccctggtgctacttgtgtacatccaaattttcacttcttaaaaagacacaaatcagattcagttaaggtctatcctaattttcacttcattacctctcattttcacttaattacctctttaagagcttacctccaaatatacattctgaggtactggaagttagggcttcgacatgtgagttttaagggcacacaatactgataggaaaaaaatattccatgtccttatgtttggttactgtatggctcaggaggccaatttaaggatttgaactgccactaagaatggctatttcagctagggatttaggaactatggaaataaacaggacagtgagtgtacatatccattggggtcactaaaagatggacttgagcagcactaaatctacgaaaacaattttaaagaaatatacctaaaccataaaggtgcagaatggttgaaaagaaagggtaaatagctattgtgcaagtactaactagggaaagatggtatttgtattaatgatcaggtatatgtaccaatagtactgaggaaatttcaatacactaggaatttatgaaaattctaagttcatatcaacctagaagtttatagatttgatgggatctcatggacatatacagctcacttgaaccagagactctagggtacacatttcatttaagtacatacaagttactttaaaaaatactgcatgctatgctatcagcatgctatgctatcagctcaaatttcaaatctgtattacactaactttgtgacataatgcaacagctgatgaaaatgcaaataaagtaaatatctgcagtaattagataagtattttaaataaattaaaatttaaaaacatacattaaaacaccttagttggtaaaacaaatcataatagaaatcaattaattcttagaccttaaagagaacaaccatgctacctgtttaagcttatgcaggcttctgttttgagataaaatgtttaacttgtatctagaagtcctttacatagaaatatcccctagaaaagcagagcatatggtgggggtaaaaggcttgtgtgaggacataagagagatactgaggctgatgtttcgtgcccccttttgtcctttattttattttatttttccaggctggtctcaaaatcctgagctcaggtcgccctcctcggcctcccaaagttctggagttacaggtgtgagccactgcacttggccccttttttccttgagtaaagatgattttcagcagcaaccaggaggaagagagactaaacataacaaatgttggcagtagagtggagcaactaggaagtgccactggcggattctaaatttatataaccagcaaacgacttcagaagaaaattgactaaaattgagcatagagtttccacatcccagaattccactactagtcacaaacatacatatgtatacaaacatccatacaaatgtatgttcaccaaaagagacgaaattcagaaagaattatttgaaatagttataaactcttaataatatgtccatcaaaagtagaatgaataaatagatgatagcatatttatacagcaggaaggggcaatgaaataaaagaacactggccgggcgcggtggctcacgcctgtaattccaacactttgggaggctgagacgggtggatcacaagctcaggagttcgagaccaccctggctaacacagtgaaaccccgtctctactgaaaatacaaaaaattagccgagcgtggtggcgggcgcctgcagtccaagctacttgggagattgaggcaggaggatggcgtgaacccgggaggcagagcttgcagtaagccgagatcgggccactgctctccagtctgggcgaaagagtgggactctgtctaaaaaataaaaaagaacactgctgcacaagatatgcaaaatatcacaaatatattcttaagtaaaagaagactgaccaaaggagtagatactatatgacttaatctgcatagtgttgataataggcaaaattaatctgtggtaacagaagtcaacatagtaattatctttgggatttggaggatgagcgtcttcagggttgttgccatgtacttttgtgtagtttggatggtgatgatatgggaatattccttatttgaaaactcagagtgtaatttatgattgtacatttttctatatgtagattaaactttaatgaaagccttttagaataaaaatatttaagtaattgataaattactgcagcattgaaggaaaatttaaaacattaaatagctacactggaaaaacagaggctgaaatatgatgaattatgtccagcataagaagttggaaaatgaccagtagactgtacaaaaataaagaataggaaaaaataatataacatgtgaacgattgaacaaaatggaaaagaaacatttaatgttgcttttcaatatcaaatgtggacaaatttggaagtttattacatgtgcataacttcttacttaataattctaaaatcagaaaaacctttgtctgaatcctaatttttctcctttgtattggtagagaaacttaaccaattcaaggatacttatgaaattcatggatttatcagagtgtggacattcatgtatttttctgtggaaataaacacatatgacaatgaattgctactccagattctattagaatattacataatatatagtttatagaacgcagaattttttaaaatttgtaaaattctgaattggtgtaaacatccaaaacacatgtacattgtaaaggaaattagtggattttatttgagctgacaactaagataaacaaaatatctattcagactcatattaaaaagcacatagtgttaagaataaaaaatagacattaaagatactctagaaattgaaataatattttttaaaagtcactaaatagaaaattttaagtaaaatggaaaatttacaatatgtaattaaaatatctgattcaataattaaaataatttttgaaaatttcttcattctcttagactaaaacgtattagatccttattataaaacactaggcccaagaaattctatagaaagtttcagtaaacattcaaggaagtgataattccaatcctgtacaaactccttcagaaaataaggaagaaataggccatttattttacaaaagtagtatacacttaacatcataatcaagctagaaaggggattagaacccaatttcatgcatgggtatgaatgtgagtcttaaccaaaatattagtaaagtgaatccagcaatatatgaaaaaccctaacgcttcacatctgataagtttactaagagcacaaagtctttttctacattgtatatccactcatacattaaaggagaaaaaattatgtaatcccctcaaaagattttattaaaaatatgatagaaattcttaactaatgcttacaagaaaatttattacatttggtataggttgtataaaacaaataaatgagcatagtatttaattttgagaggttgaaactattctactcaacagaaacacattaagaatgtctattatctttgttctgtttatcattgcactggaggtcctagcaagtacactataataagcagaagaaataaaagcatcaagaattgaaaaaaatatataaaaatagtattcaaaaattatgtgcatatttatgtagaaaaagcatctggatatataatgaatataagggattattcgttgtattcagaaatatgaccagtaacaaaagccaaattaatttccaaatgcaagcagcaacaggaaaataaaactttaagtaaacacaacttatcatagaaaacacataagtgagtgagaatatgtggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattattggacatttgggttggttccaagtctttgctattgtgaatagtgctgcaataaacatacatgtgcatctgtctttatagcagcatgatttataatcctttgggtatatacccagtaatgggatggctgggtcaaatggtatttctagttctagatccttgaagaatcgccacactgacttccacaatggttgaactagtttacagtcccaccaacagtgtaaaagtgctcctatttctccacatcctctccagcacctgtagtttcctgactttttaatgattgccattctaacttgtgtgagatggtatctccttgtggttttggtttgcatttctctgatggccagtgatcatgagcattttttcatgtttcttttggcttcataaatatcttcttttgagaagtgtctgttcatatccttcacccacttgttgatggtgttgtttgtttttttcttgtaaatttgtttgagttcattgtagattctggatattagccctttgtcagatgagtacattgcaaaaattttctcccattctgtaggttgcctgttccctctgatggtagtttcttttgctgtgcagaagctctttagtttaattagatcccatttgttaattttggcttttgttgccattgcttttagtgttttagacacgaagtccttctaatggagctcactgagcatattctaaaatatatgagatatattaaaggacattaaagccatgatactcccaaacagtaaaaatgggggggggattggatgcaataaatttgaggaatttcagggctgattaaggaaaactatgtgagcatgaatagatggtagcatgcaatgagctttattggaagctcagacagatttgcaagtgaggaaaattccctcacagcatgagaccatccatcagcactgcctagaatgggaggaaagcaagggaactgcaaggggagaggataagagaagaggtgtacaggcataagtaatatcaatcagcagcaaggtgaggagtctgtgggtctgagagctcgggggggaagtagtgacttgaggtctcgtaaccacaaggttcacctttttcatggctagctgatgttgggtgcagtttcatgaagtatgcaaagcaggctagctctaaatgactaaaaatctgcttttatggtctatgtttactaccattggatatataaaaagttgagttatggtgctgatggacttttgagctaatggttctcactctgctgtgaagaagttaacgacaaagaagaaaaatacggatgctatctttggctcatttatgcaacattggcctttgcagacaacaccatttattatatatatatgcattaaacagtgtcatattgcttcacagggagttaaaaattatgcagtgtaaaatgcatattaaaatcccagtgaaataagattttgccgtccccagtactgcaaaatttaaacttataaatgtccatgttttagcaaggatgttaaattatgagaactctcaagcactgcttgtgaatgtcaatttttgcaatctgtgggatagggagtaagtattaagttgaatgtattcattctctgtaattcagcaattcaagtatcatttacgctcatcatggatattgttacacatttctacctggagccaattctaagaatgttcacaacagttttgtctgaattagcagataaaaacaaaacaagacaaatcagttgttcaagaatagaggaatagataaataaattgcaggttatgcatagcacaaaacactaaagaaaaaaatgaactaaatgtttttatcctaatatgaatctccaaaaatataattttgagagaagaaaactatttacagaagattcaagttcaaaagcaggtaaaattagataatatattgttttagaactatatctatatctacatattaataggatatattcatattttatatatcaatatttatatatttacattaatactactgatataaaaataaacaggatatttataaatatgtaattcaatgagtagttacttctgaatgggaggaagggcatagttt

SEQ ID NO: 863 - DNA, 92661 bp, Homo sapiens
ctcatcttcaaacataagtagaaagtttttgctttcaggaatgatggcaggactagtgaatgggaagatagatcaatagaaatctgtcttcaaatgaaagcaaagtaaaattgatagtctgcacatttgggtgtagcgtctcttgtactttccttaactcttcagttttgaccctaaatttgcgaaattaagaccttgttgttgaccagatttatctgttcacatcttcgtaaggtttgcaatcatctattaatacctagttagtaatctgttaatacttttataatactaaaagttctcaccttaccctttatcccaaacaaccagacattgtatttctgcctactatttatcgtgcaattctgcaaggcttctctggtgaatgtccatgtttcatatggctattgtcatgaaagaatggcgggcagcatttagttattttatttcctgaatgtcataataaaattgtaattggcattttagagataatgaacaatgcgatgggtccagtcagtcccatagcattattaaaaacatgatttatcatattttggtaaaagctgatcaataataagggcccttgtagactccaggaaaaattagaaattcgttagtagctcagattttggaagagcagactcctgtcatctctggtattatctgagctgggacatgatttttttgtattaactcactttttatttgctattgactatctgttctcccaaaatgtctgctttcaaataggtttcagtttttaagatgcagattctctttccaatatcctataagcttcttcttcctccttccagcctgttcagaattcaaagaggaactctgaacagacttgcttttgaattgggtggactaaacttacatggaaaatctgtggactaactgcacaaattcaaatgccaatgctagttcaatctgctgtgatttgtaagaaagaggtaaaagggtagtaagatccaaaatacagcaacctatgatgtttgatcagcatggactgtaactaatagccaagcatactgaaaaaaaaaaacatttttattagcagattttatcagctaaaatatgtctagacattttatcaattacttgttttctgaggttaattcattctcctttgagtttccaaattccttttcttcaaactcttctacaattattttctgttgagttaaacagctcagaaatcaaatattctagattcaaaatttaaaaaatattcattttttttgagacaaggtatttgttgtccaggctgcagtgcagtagtaggatctcagctcactgcaacctcgccctcctgggctcaagcgattctcccacctcagccaccagagtagctgggagtacaggtgtgtgccaccacatctggctaatttttttatttttattttttgtggagatagagtattgccatgttgcccaggctggtctggaactcctgggctcaagtgaaccacattctttggactcccaaagtgctgggattacaagtatgagccacggaacctggcaacaacgacaacaacaacaacaacaacaacataaacttaggtcttgagtttgagaaaattattttgaaatttcccctctgaactttttaatttttccccaaaatggatgctgttgtactgagactaatactttttaggagacttcacagaggttcctaaggcttctatgtacttattccaagttaaattaatccttcatttctaaaacacattcttctccagaacagcagaggatgtctgtgtactaggtgttaactgctagtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgacttt

SEQ ID NO: 864 - DNA, 72892 bp, Homo sapiens
attgaatgcatgctattttgacgtaatgtcactgaagagacaggagtttgattctacactgaaacgtcaactcaaatttcaatcattgttataaatttgtgcaatttatttgcattttttttctaaatttcaggaagtgctaaaagcaaatggggcaaaattatgtagtaaatccacaagttttgtgctctcctaactgcattgtgcattgtagcaataaaaaatatttaaagagaaaaccaaaagaacaaacaataccctagaaaaagataaactttttaaaaagctgaaaattgaatataaaatacaaagaagctaagacaatgaagttaaagattgccgaatgtcaggtttgggagaacactgtagcagactgaggttcagtttcagaggattaacacggaccaaaagtgttcctatgcctggagtttaatttagattcattgcttaaagaaagaaactaagaacaaatgctgctgatggctacctgtggcaaggactcataggatcgtgtgggctgaagagatgggaaaatataaacacagcctcacagaagaaataaactaagtttgaatctgtaactggctggatccacaatatccacaaagcagaaaagccaaaatgagagacctgattccagatgctgattctactggaacatgttcaaacaagcctctatatagaagatcacatggaaggacggagggagataagagaaaaaagaaaggaaacagagagagagaaagagagggatccttttcaatcaaatgagtctgcaaacacaaatcctgaattgcctgaagaaagatgcacacaaacaaaaatcaacaattagaacattaattcattccatatgaaattgattataaatgtttcataaacatattaaatatatttaagttgctttaaaggataaattaagatttggcattgataaacaatttttaaaaagaaataaaaaaaacagagaaaatgtgtataaaatagtacaggtgcatatgaaaagaacctactagaaatcctggggaaaatatagtcattataataaaaactctgttagaataatggcccccaatgaatcacaaccttcttattttacattcttttatagtatgagtttcccatttcttcacctctttaattcagcatggctttgagatttgcatagactgacagaatatgacaagaatgatattatgtgactttttatgctaggccttaagagaccttgaacttccgccttttctgtcttggaatgaatcttttgtctcgtgaataagcaactctgggctcctatgagatgagaggccacatagaagagaagtaaaaagctacagacaagagccaacaccaaccaccagacatataattgaggttaccctgaaataaacaccccagttaaggttcagataactgaagccatatatgagtaatcctaggcaagatcagcataagaactacttagataagctcaacacaagttaaataaatatatacttgttttcagacactaaatttggaatgatttgttacacagaaattaataattaatacaaacattggcaactagaaacaaggtgctgccataacaaaatcctaaaagctaggcattggctttgggaccatgtagtaggtggtctatagaaattgctatttatgtctgaaaatgtggggatcaaaactattggcaaaacttaagacttaaatagattaaaaaaatgtatgcaatgaatgtgtagatatagccaaggtgatatcccgacagaacaatgaaattgacagttggctttttgtatctgtctataataaataggagaggaggagatgaaccaaagggagtatgattcatttggaaagcagaatttagaggaaatataaaggttcaagatgtgctgggttagaaaataaaatcatttcatatttctagactttctagctgtggtcttagaataaaaatcaaaccaagtgtgtggtgataaaacctttagttaagcacacagagaaatttatgatagtgatcagtaaatccttgcaattaggcaaagaacttctatgagtttcaagggtattatctcacaaacaccttacaaatggcccaatgtaagtagaggtttatttgttaaatagttatggatgtggcttttgaacacggagggaatctcaattagattcacaaaaaattcaaaatatttaaggtagttataatgtctcatccataggaaatagagacagtttataatgaaaagaagactctgggaccccaaatctctgtggtcaggaagcagactgggaatcccctttagttgcaaacacagtccatttattatagaaaatgaaacaaatcttagagcgtggagaccagttacctggaaggcaaagtcaagaactaaggagatcaatagttaggaaactattcagccgaggaataattgggcccttactaggatgtgttttcttactatggagaagaagactcttacaacgtatacatgtctatatttcagaatttgtaagaaccagtgacttctatatgcctaattccatttcttctctctttttttttaattggaagtgtctattgcaattattctttccctgtcttatcagcacatgttgggtatattgggtgttgataatttattatttgttatttacagttttattgaggtatacataaaaataaaaattgtgtatatttatggtgtatagcataatgttttgatatatacactgtgaaatgattatcaaaatcaagctaattaatatatgcatcagctgacatagttatgctttgtttcattgtgtttttttttttctggtgaaaacacttaagatcaattctcttagcaaatttaagtataaatacagaattgttaactatggtctccatgctgtacattagagctctagaactcattcatcccacataaccgaacttttgtaccctctgactgatattttatttccttccattctacccttgtcaacaggagttctggagggaacaaatattcagaccatagcaaaaggcatagaatataagaatgtaattgtgcacagaaattaataaaacatatttattgcttgatagtctacgtcctatatgcttgatagtctacatcctactcaggaatgcctgtagctagtgaccaattattattgcaatacaaaactcagctcctttgcttcaagtcacgatacacttagaagtataatttatgctccagagtttctcaaatgattaagcattcttggatgccaccaaaattgtatcttttctgggcttcttacctacccttccttttcctgcttccctcactcttacttgtttcttctggtagtacttgctcagtaaataacttgcacctaaatctttgactcatcatctacatctgtaagaacctgtcctaaaataaacatattagtttaagaaataactggaatttttactgacgcctagaatgtggaaacttggaaagagtattactcctacattaataacagtaaaatgtcagtttaaattttaaaaattataacttttcttgaatctgtcagagaactaaggtcttggggaaaccaattagcttggaattcaaggaaagtcaggtgtctccaagcagatgagatagacacactgaaacacatatggcagagaacaggaggaaaatacatcactgtcttgtaagtggttaaaaagaatttatcaatttttttttttcgagacagagtctcgctctgtcgcccaggctggagtgcagtggcgcgatctcggctcactgcaaactccgcctcccgggttcacgccattctcctgcctcagcctccggagtagctaggactacaggcgcccgccaccaggcccggctaattttttgtatttttagtagagacggggtttcaccatattagccaggatggtctcgatctcctgacctcgtgatccgcccgcctcggcctcccagaatgctgggattacaggcgggagccaccgtgcccggcagaatttatcaattttttttatctgaaaaagctcaagtatgggctagcataagagtatagaaccgctgggaggcatggatatcaggggtcttcataatacttgcaggctattctccacagacttctaatgggagcatgattggatacagaaatcctctaacagtggtgcagacttggataaggagagcattcatcgctacacaaacaagcataaatccccatgtaagaccttctcctctatggaacaaaagccttaaattgctggggtaagggcagcacaaaccatcacccccagggcacagatgaagatgaagctagggaaggtacaagaaaaaaacaaaatatctatccctgaggtaggggtaggaaactgtcctggaccaagttcattatatgtctcctaccactaggggaggggcagggaagtctcccatacaagacctagtaaagattcacagcaaaatttggcttctatcggcagatttactaagaaaatatcaacattaagaccaagcttgcctaagttttgaaatggtacaaaaataagaaaaaaatccttttgccccctaacaccaagatcacgaacaccaagtaataagcactaacagtctactactggagagaataagaacatgacaagatccgttgtcaggtgcaagagcaaaagggaaggccaaatgttgagggtagataagggacattaagaaaaacactctggtaatctgattttcaccctacggtattgctaaaagaattttaaactggttgtacactgaaggtaaccatagtaacagcaaaatcccaaatcagctaaactcatgactaggttgactccagtctccacataaacacactggcagaagagatgtgcatctttctttcatttttctttatctttttctttttcttttttctttttctttttcttttttttttttgagacagggtcttgttctattgcctaggctggagtgcagtagcatgatctcagctcactgcagcctcaacctcctgggctcaaacaatcttctcactttagcctcccaagaagctgggactacaggtgtataccaacatgcctggctaatttttgtattttttgtagagacgagattttgccatgttgcccagtctggtgttgaactcctgggctcaagggatccacctgctttgacttccccaaacagtgggattataggcgtgagccatagtgcctggctgcgatgtgcatatttctatgcaaaaatgctatttacttcagtctcgactgtacttttccttcatgtctaggattcagtattaaaacagaaaaaaataaggaaaaaataacccacttagaaaaagcaatcatatcaattagagtcagaaaagaccccgatgttaaaattatcagggaataaatttaaaactatgactaacagtttaaaagttttaaagcatagtttcctcatcttcaaaataattttttaaagtgtcaagtgtcaaattcttatggttattgtgcatattaaatcacataatgttagtgaagtgcatacttaacaaaatatctgacacagggtaaggatttagtaaatgacagtagttgtagtcattattacctgcaatacttaataaaatatggttgactgtccaaatgtgtttgtgataaacttggtttgaataattcctattaattatgcctttctagaaacttttgcaacaataaaataaatgctgcaagggctgattggttttatttcagatgttcctaagcatatctttaagccttaccctacccactccaagctgatttccatcactccccacctccttgctccttgcttcctttgccttaactatattttttgttgttgttattgttgttgttgtttaatcaggactaggagatgaaaggcagctgaacttcgttttcctctgtgatagaaactttgatattggtaactatttcagctctctattcaagaacactggaaagtttctggtcacaaaaaaatgtcagtgacttcactgtagtctgtaccttttttcttattgtagaactcaaaattctaattttccacttattattttatttatctctatcataaagccaaatattccaattaacaccacatagtaatttaaagtactattggaatatactttaaaattattcctatttcccttgaattttgtattgtttatgtaagtaaaattcaattataagtccatattcatatactaatcagtgatatccagttgtaatgataaatgttgtttctaaaactcttttatcattcaaggggcagaaactggattacagaatccatctcctttacccaacttttcagagttttcagctcccttttatttttatgtatcttgagttatttcttctgatagattctgtgccttgaaataatcttcaactaataaaatatttagaatttaggcaatagaatgtgtctatctgtttcaatcatagactctcctctccttgtaaccagactatatttatagtatgaatattattggccagctacccataaccaacacagatttttagtatatctaataccatcatggttgctgtagttctttcaaaatgatgtatcaaaattaaagttaatgacaagtacaatgtaaaagtaaggctgcaaggtatctctgtatttagctgccctgtgttgggatatctactattggaatcttgacagcaaattttactgctcattgaagattattccacatgcacttaagtttctctagctaattcattatagttcctcattaaattataattacttttaaaaataataattattttaagaaggtgaatccaagagctgttgatatcatgtggcttattttccccatttggtgaatgtattagttcgttttcatgctactgataaagacatactcaaagctgggaacaaaaagaagtttcattggacttacagttccacatggctggggagacctcagagtcatggtgggaggcaaaaggtacttcttacatggtgtcagcaagagaaaatgaggaagaagcaaaagcgaaaacccctgatgaacccatcagatttcgtgagacttattcactatcatgagaatagtgcaggaaagactggcccccatgattcaattacctccccctaggtccctcccacaacacatgggaattctggaagacacaattcagttgcgatttgaatgggaacacagacaaaccatatcattccaccccagcccctccaaatcacatgtcctcacatttcaaaaccaatcatgccttcccaacagtcccccaaagtcttaactcatttcagaattaacccaaaagtccacagtctgaagtctaatctgagacaaggcaagccccttcaacctatgagcctgtaaaatcaaaacaagctagttacttcctacatacaataggggtacaggtattgggcaaatacagccattccatatgggagaaattggccaaaacaaaggggttacagggcccatgcaagtccgaaatccagtggggcaaattttaaagcatcaaaataatctcctttgactctaggtctcacatccaggtcatgctgatgcaacaggtgcattcccatagtcttgggctgctctgctcctgtggctttttcaggatatagcctcccacccagctgctttaatgggctggtgttgagtgcctgtggcttttccaggttaacagtgcaagctgtttgtggggtctggagggtggtggccctcttctcacagctccactagtccagtagggtatctgtgtgggagctccaaccccatatttcccttccatactgccctagtagaggttctccatgagtgctccacccctgcagcacacttctgcctgtgtgtccaggtgtttccatacatcttctgaaacctaggcagaagttcccaaacctcaattcttgacttctgtgcatccacaggatcaacaccacgtggaacatgtcaaggcttggggcttccaccctcttaaacccaagctgtacgttcgttggcccctttcagccacagctggagtggctgggacacaaggcaccaagttcctaggctgcacacagcacagggaccttgggcccagcccacaaaaccactttttcctcctgggcctctgggcctgtgatggaaggggctgccatgatggtctctgacatggtctggagacattttccccatggtcttggggattaacattaggctccttgccacttatgcaaatttctgcatctggcttgaatttctcctcaaaaaatgagtttttttttttctactgcatcatcattctggaaattttctgaacttttatgctcagtttcccttttttttttttttgagatgaagtcttgctctgttgcccaggctgcagtgcagtgacatgatcttggctcactgtaacctccacctcccaggtttaagcgattctcctgcctcagcctccgaagtggctgggactataggcacgtgccaccacacctagctaattttttgtatttttagtagagacggggtttcaccatgttagccaggatgatctcgatcttctaacctcatggtctgcccgccttggcgtcccaaatgctgggattacaggcatgagctgcgactggccccatttccattttaaaattgaatgcttttaacagtacccaagtaacctcttgaatgctttgctgcttagaaatttcttccaccagataccctaaatcatctgtctcaagttcaatgttccacaaatctctagagtaggggcagaatgctgccagtctctttgttaaaacagtaagagtcacctttgctccagttcccaacaagttcctcatctccatctgacaccacctcaatctggaccttatttttcatatctctatcagcatttttgtcaaagccattcaacaaatctctaggaggttccaaactttcccacattttcttgtcttcttctgagccctcaaaaatgttctaacctctgccagttactcagttccaaagtcgcttccccattttcaggtatcttttcagcaacaccccacactactggtactaatttactgtattagttcattttcatgctgttgataaagacatacccgaaactgggaacaaaaagaggtttcattagacttacagttccacatggctggggaggcctcagaataatggcaagaggcaaaaggcacttcttacatggcagcagcaagagaaaatgaggaagaagcaaaagcagaaacccccataaacccatcagatctcatgagacttattaactatcatgagaatagcatgggaaagaccgaccgtcatgattcaattacctccccctaggtcccgcccacaacatgtgggaattctgggagatataattaggttgagatttgaatgggaacacagccaaaccatatcagtgagcccccacatcagtggcaaagttaggattgcaagcccaggtcatgtgactccagagtccattctcttaactactctgctatgctgtctcttacaatactttctaggccgtctaactgccactaattgtatgacctttggaaagacccttaaattatcaggaccactgctttcacatatgagaaatggggataataataaaaattattacagtgctgttttgagcattaaatgagttaatgtttgaaagcacttataagtgtttgacacactataagcactgtaaaggtgttggctaaaatgagttcttttaaatattaccttacaattatcttattggtatcagttaacgtttttataagtagattaaaagtttgtacaatttataattaaataaaagaataattgttagtccgtggctggaataagttaggactttgacattaaaaccccttatagttgtgtaattacttgcctgacaatactgagtaagcatgtggctactcaaatcctttataaaagaaattctcgtaatttagtgatattacttatgataggtagcattcactaggaatttagtatgcttcacaagctattcctaatactaaagtattaattctaattaccagaataattccatggaataggtactactattatcaccattttagagataagaaaaataaagcacagagaagtagctccaaattcatagagtaactggtagagatgagacggaagaatttatcatgtcctaagcacttccaatttagccagttttccactcttttcttctcccagcatcgtaaaatctgactgataagtataaataaggaagaaaaaataacatttattctctacaatatagtctcctcactacctgatgctaaatatgaagggacagttctaatgaaagtgatcaacaagttctagaaggaactaaagcttagttccttcctcaacctcagtgaaaagaacaaggttattagtggcgatgtttttcctaggtgtgggggagctaagcattttgaacacagcaaagataaggaagtcggtctgtaatctgcaaaaaggtaagacatttattaaagcattaatcttacctagactggcttggattttcacagtgatctcttgctcatcatgcattttaacaccccttgccacacaaccacttctaaattcttcctctaaaggtaaagagctgtatgttctgagagtaaggaggaaattcctaaaaaagtatctagaatctagaaaattattctctaggtttatgcctcatacatgattgcaaaccatagtgatgatgagcatgtttgtagaactgactttaatggtcttctacaacaattcaggctacatctgcccagagagtgtgtgtggtccacatgttctttcaaatggagaggacctaatcattaagacatagcttttttttttttttcttaactttcaggagtcagatgtggaggatatagagagaattttgacttttagtccatgttgttttccctgacacattttcaattacattgacaactaaaaaacaagaccttggcaagaacatcagggagaaatggtgatgagatgaaaagatgctcagataggcagattttgatatatgactggtcaacagaccttgggaggctctctctacaatgagaacagaagcatccttgtgctaaaggctcatctgcttacaacggttgagataaagaggaatttctcgagctagtggaagaaacaggatgagaagtgtgaaaggaaattaaattttgggattcaaaactcatttagccaaagggaaaagtcaagctgtgaactggatcatgcaaacctgcctccacctttcagttcctaaataaaatggctacaagatgcaaagctactcacctttcccatattttgccaacaaggaaattcctgatgagctgttaaaacttcaccatggcaatgctaattgatagcttatctttataggtgcagtcactcagcctgccagacacaaatgcatatcagattgttcccctaccccattttatttgtgtaatgtaaaatgcagatttcccacatttttcctttgccccttttaagtgaaaactgtgtgcttctcaatatcctgccctttcccctttaaatttggagccctcaaaatcatcttaagagaaaggcatagacctgactcctgggcgtgtccttaactttggcaaataaatctccaaaaatgattaagacttgtcttgtcattttcttcgattcacagaaggcaggatatacaagtagaaagcagaaggcaggatgtacaagacatcactctaaaacctttgaatcaacaaatgaatagcagaaaagcagatgccttgacattgtccttttaaatacacggactcaacaaatatcattgccagctcctaatatgttaggccttgctgatacattggttgactagaaagagtttcctgtcccaatggagctgatattgcagaaaaaagtaaattgtacaattaattacaaatgtgttgaatgctttgaagaagtatagatcattttgagagcctccataatggaaaatttaacctagcttagtcaaacaacacagaaaaaggcatttaatctaaggcttcaagcatgggtagacttcagcttttcaatgtgggcaaaccgatatagagaattcaggcagtgacaaaaaaaaaaaaaaagtagccttaatgtctcactcacaaagctaaatttatggttgaaaatgttaatctatcttctctcatccagaaccaaataaggattgaaaatgtatattttcagaaggattatgttaatgaatatttattgcatgctcttcctgtgccaccaaaacgctaaactctttatattcaacacattatttaatccaagcagtagcctatgtggaatgtgctatcattccttccattttacacatgaggaaactaaacatcaaagcatttacactgtatatatatgataaatccaggaattcaaataaaggtctccctagcacacataccaaactccttccacaatgcttttccacatttattagaagaaaacaggaacaaaaaaagcagtactcaataaaagcaaaataagttaccctggtgaaaaggaatgctgggaggaatgcttttggctatttataatcatacctacatcctcaaaaatccattgccagagtctatttccctgtttaacaatttgtgaggatccttagagaatcaacagcaggaggcaccactgttcagcccattagatatgatccaagatttgtctcagtgcctgactcttctgttctctagtaaggggtctatcaaaacccaatgtacttcatttttagcagaaaggacacatttcccaggggaaattgaaggtgatccttctcaaagtacaaatctagctgttttttgagatgcgatatatcgatgtctggatgaccatattgtgcaagacaattctcttcaggcccaaagttcttttcatatttacaataaaggaatgctatacagaaaaattttcacaaagatcaaaacaattcaaatagattatgccacacaatttcagtgaaaagaaagcttcaacatttacccaaagcatcatcagaaaaccacacttgctagaagacttaatgtctctcatatcacccacagagacatgagtgagtgatcattcccagaacgtgctattcaaagaaaatccattcatcttgttactagttgtcaacttcatgttttaaatctcatttcaatcacacaagaataagacattttctacacctcttagtcaatgaaagagaaatcaatacatgctttttaaaccaaaaatttatatcttcattactgagagaagtcaaaaacagaattatcttaacagtaatagtggtatataacacctctcctttttatttgtttgtgattcttttgttttcttacatagcatataaacagcttagtttatttttccttctactaagtcttcataatcatctcccttagactgagttccaaactctttggaaactactgatgcgttaattggctttttaaattatcttaaaaatataaactttattaattaccacatatgttctttcttttaaatattaatgacttggccaggtgccgtggctcacacctgtaatcccagcaatttgggaggccgaagggggtggatcacgaggtcaggaggtcgagatcagtcaagccaacatagttaaacccatctgtactaaaaatacaaaaaattagccggttatggtggtatacacctgtaatcccagctatttgggaggctgaggcaggaggatcgcatgaacctgggaagcagaggttgcagtgagcagagatcacgccattgcactccagcctgggtgacagtgtgagactctgtctcaaaaaaaaaaaaaaaaaaaaaaaaaatatatatatatatatatgtgactcttcatcaagtagtttctatgaataaaatcagatttcacaaactctgtaaagtgggagaatgaaaatctagtaggttttacttatctgccacaactaaaaattagtatagatttgaggaaatgtcattttgttttgaagagtgtgatttaaaaaaaaatatatatatataatatatatatatataatcttaatttgctttgtcactcatataaaggaaaccgtagttgagttgtagacaatgaggaaacacttgaggcttccgctgtatgtttctttgttattgttatgttgttacccagtaacttgaatattgtttaaagtgttgtaagacattgtagagtttatctcaagctgttaaaaatggtaatgtacaaatgtgaatagacacttatctatataatatgggtaagttttgttttgcctataatagatgtttataaaacaagtgagggagcagttggtatttttatttccttttctttctttctttttattgaaaaatcaagattgtataaaccaaaagctgcaagatgccaaaatcttgtagatgtcaaataaaaagttattttactaaaaaaaaagtgtgcgttggtaatcactactattaataattttaaaaaggataaataaggtcatataaccctgtctctggttcagcaatttggaaaagttgtagttagaacaggagactgttctaatagagagagtgaagagtacaatatgtagtttagttctctcatttggtaggtgcagacacagaaggaatgaaaggctgcatttacacgattagctagatctgtacaaacatttagtactttaacttttctcaaagccttttatgtattatcctatgggtaatgttatcccaaatgtatggataaaattaaaacaagaacactaaatgacttcacaaagacctgaaaggcagatcaacggcataactaatattaaaactcaggactagtgctctgaacatcaaacctcctggatgaggtcttccgtggcacatctctcatttgttgaacagtttttaaaatactgtgtgctgggctttaggttgagagataggacacgtgatttatcccttcagggtgtttgcatcataaagaggcctgtgatcttcaattaatcatgtggccaaagttatttctaggggtcagggagtcattgacaattcattatgccaaatgtgccaaaatgccgaaaaaaaaaaaaccaaaaaccaataatgtaagtctcctgaatataaaattttcaaaaactgaattagaaacatttttttttactctagcaagagcaattcaataaaagcagacatataaaggataattttttaaatctgtgaccaaaattgaatatgagattgattcatctacaaagtgtcttacttttctgtagtacaataaaataaattatactgtcctagacaggcaaacttcaatataagggagatttaatgtcgtctgtcctatcatagtgaaatttgactccactattagtttctgaatactttcatgatttccctcctgctagtttaccatgagacaccatctcagacttctacacagctcatttgcacccatcacaatatataaataaacaggagtgtgccttttctctgccgtatttccactcaactaattcctgtatctttcagctccaccagttctttgtatacttgcaaataatggctgaaaatatttatattttttcttgacttcatatttcttctacacactattagttttcttactctgtaatttaagtgacagatttggagtgggacaaatctgtatgaaaacttataaattaaatttcccatttaatgagaagattttaagtagaggttaattggtaaattactttctcccttttcccccatgctcttttcatattctgattgcattatatgtatgtatatttctagttatgtgtacaactatacaaaatttgggaatataaattcatttcattaacacctgtaccctttttgctcctactcaactcttttttgcacgcaattcagcaaaacttttggaaatagttgtccatattcactggcttctctttctcattttttcacctctcacacaatcctttggaataaggttttcatcttcataattccacagaaacggggaacactcatgttgccaaattcaatagctacctctctaacctcttcttattccatctcttagcacacaacacagttgaccagttgctcatgccctgtttctttaaaaactcctttttcttggcttttttgaaccacacttgtctgtgacagccaccactccttgacagctgtgctgtctccatttgacctctaaatgttaggactgatttgtgttaatagaattataggttacggagatggagccctcacaaattggattagtgtccttataagggccaaggaaaccagagctcttcccctcaactatgtgaggacagagtgagaaggttccttctgagtcatatagtgggtgttcaccagataccagttttgctggtgacttgatcttggacttctcagtacccagaactgtgggaaaaaaaatttggctgtttataaactactccacttatgctattttgttataattgctcagagtaagaaatgaagatatttcatcttacttatcttattattgctatttctccagctttggacacaatacttagcactttgtggaaactcagtatattttttaaatgaataaatacataaatgaattcaccaaataggtagttaaagaaccataaaaatcatcatatccttgttttcgaagtgaattagaaccagctgagttgcacagaattgtaaatcagaacatcttgctgatctttatctctgcatacagacctgattttcatagaactcactgtctgaattacatgtgacaacagatacaaggatgtagatttcactttattttgcaaacatgaatttcatcatctacatagtggatagttgattctccagtgaagtcagatttctgaagtgttaatttaatattgtgctattatactttaaaaaaaaaaacatagcacacatcttctagtaaaatggcacatatctttttgcaatagtcaggaactacagacatgagctaaatcatgtatttgaaaggtagtcccagagtggctaagtcagaataaggtatatctttctttctaaagtactgctttgattatattattttctgctcctcaatccacagtagcacctattagcagttctgcctttggcaattgacatatgttatctcctgttgctatttatcaatttactgtcagttatgttctctctctccaattggactgtaggtttttggcaagatgcaatctggaagtaagctctatcaaaagtagttattgaatagatatttgtaaaagattacgatgaaaacatttctaactctccaaatctaactccaccttatctttagtcttaaacacaacgtgaaaattaaactaaaaacattgaacaaattaatcttgacactgtaatatattgcaatggctaaaataattttgaatcctaaatattaattttgttatacatcttttttatatatatttccctgtatggaacatgttatgaataaatacttgatgttctttacacagtctagagcttgctacatattgttgatcatctcagaaacagcttaataaaatcagcatttgaaaatcccagtatcagcacctgtgacattaataattctggtgaaacaggtgcttcctgggaatttcaaacatttgaaaataaagtgataggccggacgcggtggctcacgcctgtaatcccagcactttgggaggctgaggcagatggatcacgacgtcaggagatcgagaccatcctggctaacacggtgaaaccccatctctactaaacaaaaccaaaaaaattagccgggcgtggtggtggacgcctatagtcccagctacttgggaggctgaggcaggagaacggcgtgaacctgggaggcggagcttgcaatgagcctagatcgcgccactgcactccagcctgggcgacagagcaagactccatctcaaaaaaagaaaataaagtgatacttcgagggaattagttgtgtcacagataaaaatagattgtgcttcactgcactcattttaaaacatagtgactgtcttcaatgctactttacaagtgaggaccagataattaactgaagtttctttctcaagcctgattgcgttgtttctttttcttcactactcttctcctttactgtcccttcaccatttaggaggaggatatgcttttctacacatctgttccttaggaggatggttgatacagctaccaaaaaaatttgtttcatgttttaaagtaatcatcattctcagtaaactatcccaaggacaaaaaaccaaacaccgcatgttctcactcatagatgggaattgaacagtgagaacacatggacacaggaaggggaacatcacactctggggactgttgtggggtggtgggaggggggagggatagcattaggagatatacctaatgctaaatggcgagttaatgggtgcagcacaccagcatggcagatgtatacatatgtaactaacctgcacattgtgcacatgtaccctaaaacttaaagtataataataataaaaaatatgctttgcagagttaaagcaaagaaaaagtcgtaaaagacaaactatattttgtctgtgagagccagcttgttaagacagaaaagttgtttcttttttacatttctaaaacttggttttaaatgtgaagagacaaatactaaaagcaacagaacttaaggtttctctgtaaacaaatgtgtttgtttcagtcataccagatattatgacaaacaaatgctaagtttatgagatttaaaaccatgaaagtatatttttgaatgcattaaaataccgtgaaggtgttaatggttcgtaactgggagtggcacaaaggccagttctgcctcctgaaatcattgacagacactgagctgatggaagatttgtttttttaaatatatctcttttaagatcatcgtgggtgttaacaggtagccaagaatgtaagaaggagaatattaaggttgtacatttgcttaactgccttggtctaggaaaaaaaaaatatcttccatgtactttttagcctgaagaagttacttgaccccagtcagataaaaagaaagctgacaaataaccatatcccaggaataactctgttttctacaagaggactaaaacaggaagccaagggaatgagtctgtggttatcattttctaaaaagtgggctctgtcccctgtcaatttctgaagttgaaattttagaggtagagagaaacagaaaccaacacataggtatgggactcagagaccagagagtgtttgtgctcaacttgctttatggaactcagaagagatataatctcatggagaattcactgctcacacaggctagcatcagcagaattgtaatggtggcaaaacagtatagtccgatatatagattgaaataggacccatcctcagtctatcagaggtccttaacgatgcaggagatcatctgaaaatagcttgtcctgtcccatattgattcaagataggccagagagaccttttagttgcaaaggatagacagagtaaatagcaagtacctaatgactggagaacagggtagcagcatagacatggatatcaagcttaagtagggataagtgttgacaacctacggtatgctggcattggtggggtgaggttttcttctccttagaaaagaattcagttaaatagaggtatagaagaataaatagaagtatttaatgatatggcttagcttggtggtttgaaatacatgcctgctacatctggattctgaatatttctgtatttgtaaccatctcaaaaactccagggtattaataaatttgtccataaatacttaacaattggaaaggcatatggctttagatttaccttttcatttcaggattttactcattaaatcagtattagatgctgcagcataattaagttgaagctgacatttgagaacattatttgtttttctctttcatgacatctaaatacatttgatattttttcccaattgccaatcaagtattcttccactagaatttacttttacctgattttaaaagaacattccaatcatggttggtagccatatggacctctcactcaactacaatgtcagtggctctgggagctatttgtctgtgtctgagtgataaaatctttctcagttccctttgagataattttcctctcattttctactgccaaatggacaatctttggatttctccctgaagtggtctttattctcaagtgaccttcaaatggtttacctctgagatattcccacagcacacccaaagtgaagatatagccccttcaaagttggcaacaatacatctagaagttttctcatggtggtaaaatagacaataatttcattttttctaaatagactcactcaagtcaatatccacacagcttcccacacacaataacccattccttttgtatacccttggtgccttagtctaggtcttttttctgaccatagcatccttcattatcttttcagatctcacttctttcaacatcaagccttcttatgtccagtgataagatttatgtctttttgtaagaattttatgtatttattaaaaacatcatttaattgacttaatcagtttcattgggattacttttaaatctttattaaagatccttcagagcaagggccattttatacatcttttttggtaatttttctatattgttacctaagttcacattatcatagagattaatcagaccacacaaaacagtgaaattgatagtgactatagagttagcctgagtgttcagtacaggatgactggctccttttgaataataaagatgatctctaaaataatagcatatatctcattaatacaattatgatatcttgaactgtgcaggacaaacagtcctatttttattatatgaaatagtctttgtaagtatctaattacctacttcccttgataacactgaaaaaagaccttgaatcttaaaaatttccactttaaagtaagtatagtgcaaggacagatcaatgtagtactatgtttttatgccctctctgcagcgagtttatatataacctgaacttttcatagctcccaaatccaaaaaaaaatgcttgcaaccataatttactttttacatttaaactatcgacaataacttcatagcactggtccagttgctcatttcacttgtgaaaggggtcaaattttcacctagagttttattgaatgccacattttatagtaactgttactcaggcttattgtttctcacagttgtttgtttatttttgtgtgtgtgttgttttctcctatgtttatcatcacggttgcttcctgaggaacttttgctagtcgtcgcttcaaagtaatatctccttttcaagaatgggtaacttgataacaatgaaacaatcaaggtattgactcagaaagacttaaccaatgtaaacacacttctctttactgatattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtctcttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgttgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctataaacatatgtgtgcaagggtccttttcatataatgacttgttttcattgggatatatacccagtattgggattgctggattgaatggtagatgtacttttagctctttaaggaattttgatactgtcctacatacaggttgtactaagttccattcccatcagcagtgcaagctgctttttccctacatccaccccaacatatattgtttttcgacttttcaataacggctattcttgcaggagtaaggtgctcattgtggttttaatttgcatttccctgaagattagtgatgttaagcatttattcatatgtttgattgctgtttgtgtatcttcttttgcaaaatttctattcatgttctttgcttactttttaatggaattatttggggttttttccttggtgatttgttggatttccttatcgattatggatactagtcctctgttggatacatagcttgcaaatattttctcccattctgttgatcatctgtttactatgttatttcttttgccgtgcagaagctttttggtttaattaagtctcatttatttattttggtttttgttgcatttgcttttgtggtcttagttataaattctttgcctaggccagtgtctagaagagtttttgtaacactgttttctagaatctttgtggtttcaggtcttaagtttttgatccattttgagcttacttttgtatatggtgagagttaggaattcagtttcattcttctacacgtggcttgtcagttttcccagcaccatttattaaataaggtattccttcaccaacttgtgtttttgtatgctttgacatatcacttggctgtacatatttggctttatttctgggttctctgttctgtgccacgagcctatgtacctacatttataccattgccatgttgttttggtaactgtacccgtgtggtacaatttggagtccagtaatgcgatgtctctaagtttgttcatttgcttaggattgctttggctatccagcctctttttaggttctaaattaattttaggcttgctttatttttctaattctttgaaaaatgctgttaggtgtttgatgggaattgcactgaatctgtagattgctttggcctgcatggtcattatcacgatattgattcttccaatgaataaacatgggatgcatttccatttctttgtgtcagctatgatttctttccagagtgttttgtagttctccttgtagtgatctttcacttccttggttaaggtatattcctggatttcttttttatttatttattttttattattgacagctgttttaaaagggattgaattcttgcttttattctcagcttggtcatttttggtgtgctactgatttgtgtacattgattttgtaatctgagactactcaattcatttatcaaacctaagtgtctttggaggagtcttaggattttctaggtattcaatcatattatcggcaaacaacgataacttgacttcctcttttccaatttggatggcctttatttctttctcttgactcattgctctggctagtatttatagaactatgtagaataagagtggtgaacgtggtcatccttgtcttgttcctgttctcagggggaatgctttcaacttttcctcattcagtatgatattggctgtgggtttttcatctatagcttttattattttgaagtagttttcttctatgcctagtttattcagagtttttatcataaaggggtgctggattttgttgaatgatttttctgaatctattgagatggtcatgtagttttgtttttaattgtgtttatgtgatgtttttaattctgttttctgtgacgtattctctctcgatgaatctagctaatagtctatcagttttattttttcaaacaatgagttttgcgtttcattgattttcatatatttttgtgtttgaattttattgagttctgctctgatctttgttatttcttttcttcttctagctttaggtttattttgttcttgtttcttctgttccttgaggtacgacattagatcgtcaactgtgcttttttagactttttgatgtaggcatttagtgctataaagttccatcttagcactgcttttgctgtactcgaggttttgataagttattgcactattattcaattcaaagaatttttaaagttttgtcttgactttattgttaaccagataccattcagaagaagattatttaatttccatgtctttgtatagttttgagggttctgaaactgcctttgcaaaattataactgaggaaattatgacagtgcagtgaaataaatcagaacttactaactctatcttgcttctaacccttaagctgtccttgttcattcctgggtgtaggctggactaactttgggaaggaatttagttcatggtttgactctgaaacaaaactgataacaaccctttcttgcctggtgtccagtctgctttttcaggactaataaattagctacaagattaaaaattataatttaggggtcatacagcctctggctccaagagtctgaaaatccacaaattgctcctagggataacaccactattgtaaaacctaagatcagtgcttgagatattttgcagaccctgaactccatagatcagccaacaccacccagaccagtaatctggcccaaccagttctgccaatgcacccaagtacagaagacattaagaaaacctaactttgacctcctatggttccatctccaacttgaccaatcagcacttcccatttcccaagcccctacccaccaatttatctttaaaaagtctgattcctgaattctcggggagactgatttgagtaataataaaactccagtctcccgcatggccagctctgcatgaattattttttcaccactgcaattctcttttcttgataaatcagctctgtctaggcagcaggcaatgtgaaccaattgggctgttacagttctttgtgaagttgatttctagttttattctgctgtggtctgagaagatatttgatataatttccattttaaaaaatttattgaggcccgttttgtgacctattatatgatcagccttggagaatgttccatgtgaagatgagatgaatgtgtattctacagatcttaaggtaaaatgttctataaatacctggtaagcccattagttctagtgtatcctttacatttattgtttctctgttgactttctgtctcaaagatttgtctagtgctgtcagtggtatatagaagtctctcaccattactgtattgctatctcattacttagatgtagtagtaattgttttatgaatctaggagctccagtgtttggtgcatacatatttaggattataatatctacttattgaatttatccttttatcacatatgtagtaatgatctttgtctttttttaaatttttgctgctttgaaatctgtttggtcttaatatgagtatagctgctcctgctcacttttggtttccatttgcatggaataccttttcctacccttttactttgagtttatataaatccttccctgttaggtgagtctcttgaaggcagcagatatttggattgtgattttttaaatccattctgccattctgtatcttttaaatggagcatttaggtaacttacattcaacgttaatattgaaatgtgaagtactgttctcctcatcgtgttaattgttacacagatagtttcttttcattgcattattgttttataggccctgtgagttttaagcttttaagacattctattttgctgcatattgggtttttgttttaaggtttagaacttcttttagtatttcctttagtgctggtttggtagtgacaaattccctcagcatttgtctgaaaatgactttatttctcatttatgaaactaagttttatgggaaacaaaattcttggctgacagttgttctgtttaagaaggttgaaattaggaccccaatcccttctggcttgtaaggtttccgtggagaagtctgttcttagtctgataggttttcctttatggtttacttgatgcttttccttactgttcttagaattctttctgttgactttagatagcctgatgactatatgtcttgctgaagatctttttgcaataaatttcccaggagtcttttgagcttcttggatttggatatctagatctctagccagaccaggaagttttcctcaactattccctcaaatatgttttccagatttattattttcacttctccctcaggagaaggaaagccaattattgttattcattttatgtatttccatatttcttagagactttgttcatttttattcttttttatttttgtctgattcagttaattcaaaagccttgcctttgagctccgaaaattctttctcctagttgttctagcctattgttaaacatttccacggcattttataattattgcccaagtgtatcttttattttcagagtttctgattaatttttctttacgatatcactctagaaaatttttcattcatatcctcaactgccttctaaatttctttatgattttttttttgcctttctctgatatctccttgagtagcttaataatcaaccttctgaatttatctggtatttcaaaaatttcatcttggttgggtccactgctggagaactagtgtgatcttttgcgggtgttatagcaccatgttttgtcatattaccagagttatttttctggtccttctcatttgggtagactattttttctaattattctttattttacatttgatttaattgtgtttcctttgtttgtttgcttttaatttttttcctctttaaggatgagacttcaatgctttgagttaattgtagcctaatttggttcttggtgctttcagggtcaaagactctgaagagtcccttggttatagaaagtgtttgtatgatggctttctcatatgctggtatagtagcaatgggctcagtgtggaaacaaattcagtatctcctatggggttggaatggtagaggtctcttaaagcttatctcattcccctgtggtggcactttatttatttatttatttccccccatattttatttactggtttgatggttcagatttcaggccagtaggggaggtatccctgggtagggaccagttgtaggtaaagcaggtggataaataaagtcccagcattgacagaggtaagtggaggagcttaagtgagttgcactgaggttttatcaagtgaagttttggaaccactttagctccctgccaggtcagtaggaaagttatccacctctcagacatgctactatcccagtgttctggttattcagatcaggcaggcacccttttcatctgtagaaatgttgaccttccaagtagagaggaattgtgactctgtctctcatgcaagcctgaacccaggtagtgctccttctgtggggatgcagtaccctgatgtgttccagaaatgctgtctatggttgcacccatactgagctcctgttggagaaacccaaactgcgcctatgatggtggataaggggggaaaggcttcctcttctccagtactcttcatggataccaggactgtctgactgttggaactgtctgactgagagctgaagaccttccctgcctagccccgcacctcaacagtactgctgctgaaggaagctttccaccagtggaaggatcctgtggtcaaggcctgccatctggattcttttgtcttacagtgtgttctcttggggttggaatggtagaggtctcttaaagcttatctcaatcccctgcggtggcactttatttatttatttatttccccccatgttttatttactggtttgatggttcagatttcaggccagtaggggaggtatccctgggtagggaccagttgtgggtaaagcactctcccttcccctaggagtgggaatccctgggagccagactactgtgggtgttgttgctcctctgggtctagctgctcagtggaattgccccactccaggctggtgttggggaaatgtttgcaagggatccactgatgtgacctgtcctcaagttttctagcagtgggtaatggcaccagctctaatgggagtggcaaaggagtgacatagattctgtgaagttccttggttattgatagtcttagtgtgttggctttcttgaacactggttatagcagtgatgaactggtcacatggacagattcaggagcccctggttagccagagcggtgtaggcaatggtgatagctgagatgcacagccttctccttcttggacacggtgttattctaccaagaaatacagtaatggactgtgtcggttgtcctgcagccaggaggtggtgcttgccaaaaagcatcagctgtggtggcaaccgtggcagttttgcttgccttatgtttcctgttggaggggagtatctctgatttctcaggcaatgggcagggccaagtagctcccaagagattttgatctttttgttgagctaccagggccgatggcagggcaaagccaggtgggagctgggttgggcaggtttgcattctgagtctctgtgtgtagggcaaacagcagcccctgtgggtttttggggacaggggcaggtttcaaaccgctgggttgatgttccagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttggtaaggcggtaatcagcactcaccactaacagtagtcataagattttcccacagagaaagcaaccatggcttttaggccttgcccttctctgtctgctgcaaagccaggcacctggcatctgcacccagggctcctgcacccatgggcctacactcatgactcttgcactcatggcacgcttttcactctccccatcctggccctggccaagggagttcgtgtccacccaaagttatattattaaatccctttgggagcctctttctacctgtggccaccacttgaaatgtttggctctcttcctcagcaccctttgtgaggaacagtaaagaatagctaccctcagttcacactgggatctaggagtccatgcaagggtcttcccactgctgatcctacttttatactccatgaccctccccaactctgtttctgcacagggtggggttagggccttcccccgtgtattgagctttcagggtccccagtgggagtgtatatcctagaggcaaactctccccttctcatactctatgtactcacagcctttgcctgactcacactgtaggctgcagcctctagcatccttcaaagtgtccataaattcctccggttttcctgttcagttcctgtgtcacttcttgaaaaaaattcacagtgtgaatctctgcacactattttgtccttccaagtgtgagagatatgctagcaatgccttcaatccaccatcttggggggaaaaaactctaatttgcttttaaattagattttgtattaagacttttaataatcaaaataatcactgaatgctgaactgaatttttaaaatattaaaaatagcaatagttcagtctgttaatcactaacctaacatacacatttattaaaaccctatttccaaagttgaactgtaattaagtttgtatggagagattcacataaaagttaccccattacttctttagtagtttttttgttgttgttgtttgtttttgtttttgagatggagtcttgctctgttgcccaggctggagtgcagtggcaccaacttggctcattgcaacttctgccttgctggttaagtgattctcatgcctctgcctcccaagtggctgggattacaggtgcccaccactacacctggctaatttttgtatttttagtagagatggggtttcaccatgttggccaggctggtctcaaactcctggcctcaagtgatccacccgcctcggcctcccagagtgctgggattacaggcgtgagcgaccactcctagaccctttagtagttttatagtttgggctcttatgtttaagtctttaattaattaagatttttttaatatggtgagagatagggaatctagtgtcattcttctggatatgaacatctgttttcttcctggaccatttatcaaagatggtatctttcctcaatgtatgtttttggagcatttgttgaaaatgttccaatagtcacaaataaacattctattaaaaaattttttgaataatggttagcatctacattacagttaatagctaggtcttactgttaataattgactaatgaactgttatactaatattcactttcaaaaccatcataaaaaaacagttttatgaaatagatacttttagaattaatggttaatgaaaacattcatttttttctataaagttatttttgtgtaatattttttcttttttattgatacgtaataatagtacatatttaagaggtgcatgtgtgattttactacaagcatacaatgtataatgatgatcaattaaggtaattaggatattcatcacctcaaacatttatctttttgagtgttgagagcatttcaaatctttacttccagctattttgatatatacaataaactattgcttatgtccccatccctaccctcatttatgcactttttccagcctctggtacctatcgttttaccctccctacatgagataaactttttaacacccacatatgagtgacaacatgcaatatttgtctttttgtgcctggcttattttacttaacatagtccatcagttccatccatgatggtacaaatgacagagtattatatttttatggctgaaaagccttttatttataaagtttttatctgttaatctgttcacaaacacttgtattggttctatatcctggttattgtgaacagtgctgcaataaacatgggaatgcaggtatctacttaatatactgatttcctttcctctagataaatacccagcagtggcattgtggggtcatatggtagttctatttttagatttttaaaaatgaacctccagactgtttttctataatagctgtactaatatatatttccaccaacagtatataattctcttttctccatattcttgctatcatttgtgtgtgtgtgtgtgtgtgtgtgtgtgtgtgtgtgtattttgataatagccatgctaattgggtcgagataatatcttactgtgattttgatttacatttccctgatgattagtgatgttggcatgttttccatattcctattgaaaacttgtatgtctacacttgagaaatatatattaatattatttgcccagtttttagggagattatttgattattctgttgttgcattgagttcctcatatattctgcatattagtcccgatggatgaatagttcacaaatattttttccagttctacaggttgtacctttactatgttgaacatttcttttactgtgtagaagctttatagtttaatatagtcccatttgtctatttttttgttttgttgtatgttttgaagtcttagtcataaaatatttgcattgactaatgttttgaagaatttctcctatgttcttgtttagtagttttatggtttggggttatatttaagtctttcatcaattaagtttttttaatatgatgcaagatagggaatctagtgtcattcttctgcatacggatacctgttttctccaggaatatttatcaaaaatggtgtctttcctcaatatatgtttttgaaacatttgttgaaaattggttggctgtaaatacaataatctatttccaggttttttattctgccctgttggttaacgtgtctgcttttgtgccaatatattgctgttttggttaccatagcttagaagtatatcttgaactcaggtagtgtgatacctccagctttgtcttttttgcttaggattgctttggctatttgaggtttttacggttacaatttttcttttaatttctgtaaagactatcatttgtattattttttttgagacagactctacctctgttgcccaggctggagtacagtggcacaatcttggctcactgcaacctccacccttcaggttcaagcaattctgctgcctcagcctctcaagtagctgggattacaggttcacatcaccatatctcgctaaattttttgtatttctagtagagacagggtttcaccatgttggccaggctggtcttgaactcctgacctcaggttaactgcccacctcagcctccaaaagtgctgggattacaggcatgagccaccatgcccagattgtattttgataggaattgcattcaatctgcagattgctttcaatagtatggtcattttaacaatatcaattttttcaatcgttgagcatggaatatttttccatttgttttcatcctcttcaatttattttatcagtgctttgtagttttcctaatagagcaattttcatctacttgtttaaatttattcctagttatttttatagctcttgtaaatgatattgttttcttatattcttttttttatctagtttgttattggtgtatagaaatgctactgttttatatgttgattttgtattctgcaagtttactgaatttgcttatcacggctaagaggtttttggtggaatctttaggattttctatataaagactgtgttatctgcaaaaagagacaatttgtcttcctcttagattggagtgtgttttctcttctttttcttgactaattgctctggatatgatatcaagttctatgttgaataagagaggtgacagtgggtatccttgtcttgttccagcaggtttccaccttttctcaatttcaccttttctcaattcagtataatgttagatgtggtttgtcatatgtggtctctattatgttgaaatatgttccttctatgcctaattagttgacagtttttatcatgaaaggatgttcaattttatcaaatgttttcctgaatctattgagatgatcatataatttgtgttcttctttttttttcttttttttgagagggagtctcactctgtcacccagactggagtgcagtggcacaatctcggctcactgcaacctccacctcccaggttcaagagattctcctgcctcagcctcctgaatagctgggacaccaggtgtgcacccccatgcttggctgatttttgtatttttagtagagatggggttttaacatgttggccaggctggtcttgaactcctgacctcatgatccactgcctcggcctcctgaagtgctggaatttcaggcatgagccaccacaccgggctgatttgtgttcttctttctgttaatgtgatttatcaattctattgattagtatatgttagatcatttttacatccctgagataaatcctacataatcacagtgtaccacctttttcatgtattattggattcagtttgagtactttattgataatttttgcatctatatacatcagagatattagcctgtaattttcttttttgttgaattcttgtctggttttgtaatcaggtttagctggccctatacaatgacataggaagaattccctcctcttcagtttttttaaatagtctgagaagaatagatgttagttcttctgtataggtttggtagaattcagcagtaaagccattcagttctgagcatttctgagttgggaggtttttttcagctattattgcttttgattctatctctcttatagctcaaataatatctgtttttcctatcagggtgctgtggtgttggtgaatataccttcacaaatgttatatactcttgaaaattgattcctttattattatataatgatgtcctttgtctttttttatgtttttgacttaaagtttattttgtgtgatgtaagtgaagctactcctgcacagtttttgtttccctttgtgtggaatattcttttctgttccctcactttcaatctatgtgtgtcttcacaggtaaagcaagtttcttgtcaacagcatatagttgggttttgtattttttatccattcagccagtacatactttttaagtaaggaatttaaaccttttacgttctggaatgttattgataggtgacaacttactcctgtcattttgtcaattattttctaatgttattgtatattgtttctttcattctcttattttttacatttacaatttgattatttttgtagcaacaacatttgatagctttctctttctcattcgtgtatatactctaccagtgaacttagtacttttgtgtcttttcatgagggtagatatcttttcactcccagattttgcattttcttaagcatttcttaagcatcgtaggatcaacctattggtgacaaattcccttggtttttcttgcctgagaaaggctttatctctccatcattttggaagaatagctttgcacagtttattattctttactgccatgttttgttctgttttgttttgttttgttttgtattgttagtactttgaatatcccattctttcctggcttataaggtttctgctgaaaaattttgagaaattagctgttgatctgatggggatttccttatatttgatgatgttttttcttgctattttgatggttttactctaccttaaacatgaccttttagaattgaatctacttgggaatatttgttgcatttcctgtatctgggtgaattcatgtatatggatgcttcttataaatggatgcttcttataaatggatgtatatattttgttcaagacttgagaaattttaacctatcattttgttacataagttttccatctctttttctccacaattcccaaaatttgaatatttggttactttatggtgtcccatatgtcacataagctttcttcattctttttaagtccttttttcttcttttgtctatgacatttcaaaagacctgtcttcaagtcagaaattctttattctgcttgatgaagtctattgctgaagattttgattgtatttttatatcactgattgaattcttcacttcaggatttctgtttgtcttttttatcatatctagcaatttatcattcagattataaattattttctaatttcccaattgtttatctgtgttatcttgtatctggctgagttcttcaatattattattttgaattcctttttagatattttatagatttttcttttttgtgatttcctactagagaattattattttccttcggtggcattatgtttccttgctttttcatgtttcttgcatctttaaattgacatatcagcacatcctgggtgacagtcacttacttcagttacatggattggcttttacgtggaaacactttttttcaattgctgagcagttctgctttttaaagcagcaactgagctgtaaagcagacccatccttagacaggaaactgaatctacgtgggaggaagacacagtggtgggcaatctggaagctagaaggaaggacagtcagagtgagtattgtaaagccagaagcatggcttatctaacaccccgctgggatatctaagagagcccccttctcaggtttttttctgtctcaaaagaaactgaggcatgggtagtgataaaatcacaagtaatctcaccctaccaaaacccagtctcctcattaaatgctacagaagtctggaaggagttctcattatacaggcctatgacactctcactgtccaacagtcttcatttctggttttgttcaagattatatccctctcacacacaaagaaagcatttatcatgagagaattttggtactttatgaagttgtctgcctttaattatttatattgtcttctttctcttagtatttttgttttttttttctttagggaagggatagaggggactgtttttgatattgctattcttcttctgtcatctaggtaaagcttcctttgaaaatgccaacctgtttgaacactcctcaggagacatgatgaaagatgttctctataatttatctgtatattcccagtttccaaatatggcaataacagcaagaataaacagacggatatctcaataagatgaaaaattagcaggaactgatgaagggacactcttatcgctgttgctttccattatgattgttgaactcaaacagctcttcctgtgtctcaggcagaatcaattatagatagaaaattaacttacaaatatctttatttacttgattaggaaaaggatactgagtagtcagcaagtaatagttaaaaagaaatcataaaattggaatcacaagatctgtgttccagggcttcctttgactttaaaaagtggattacccttaactgagtcacatacttctttaagatttttttatatcatcatctgtacaacaggaacagcaaactagaagatctctgagatccccttaaattttaaattgtttcaaattataccctaagatatctgagcaagaaagatttaaagagcaaaattttacctcaacagagatgagagtttgttagtgtaattgagggggtcaaaacaaaataatatattgttaaatagtgggtgaagacttagagtgatagaagtcttttccataaaaaaatttagtttttaataaatcctttcactgacatcaacacagtaataaaggagaagcacctataacacggcttcaatagcaatttttacagcaatgtgtaaaacatgccatcagagaagaattcctgttccttaaatttccacgttacccagcatctgccatagctaacaggaaatgaaatagaataaactatggaaagatattgaataaagactccttaactatggagtttgataatttgaagtaaggaaataagaattctctgcttttagaataagaaacataattccaacaaatgaaaaatctactgtttctccctgtggaatgtgaacaatctagcataggtttctgaagggaacctggcgctatggtagaaaatgatcagaactgtattgatttacatatgtttcttactcttataggcatataggagccttgcatgaccacactttaaacaaatattttcacagtatttattattgatagcatacatgcattaaattgttttttataaactctaataattaacttcataaaccgtcttaaataaatgtttttcttatttgtataatgaccttagtttaaaatgtaacctttcagatattttcagaattacgtacataaagagggtgaacctatcttagaaatacaatagtttccgctttccagaacaataagactaatgaaaaaccgctttaaataatgttgcttgagggatggtttctctctaaacaccagaatgtgtagaaaatgtttacacggcaaaataaataacctgttaagaggcttaaaattttagttagaacaataatatacacagtcaacataaaagccttgtttacatggttgtttgggaatattttaaaacaaaaacagtttgcttcatattcagatctcccatggctcccaaagaagactttagttagagaaaaagagttgtttaaataaagagaattcatttatttctgttatagtgtaataataataactagtcatttatagttattcatacatttgtataatttgaacaaaagccatcagcctgaggctttctttctcatttctgcaaataaagatatagagtgtttgaggaattcatgtagtttgcaaatatttgcttttggagacaaatgatgataattaaataaaatgctgtgtgttttgttgaatgagcaatgtaataacatttaggcatgtaaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgcattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaaagggatgaaaaagcatatttcatgccaatgtaaaccaaaaaggagcaagagttgtgatacttatatcaggcaaaatagatttcaagactaaaactgcaagagacaaagagggtcactatataatgataaagggatgaattcagcaaaaggagataccagttttaaatatatatgtaccccaacatttggagaattgagatatataaagcaaatattatagctaaagagagagatagacctcaatacaataatagctggagacttcaacaccccactttcagcattggacagatctactgaacagaaaatcaacaaggaaatatcaggcataatttgtactagagaccaaatggatctaatagatatttaaagaacatttcatccaatggttgcagaatacacatttttctcctcagcatattgattattctcaaggataggccatgtgttaggtcacaaaacaactcttaaatatttcaaaacaaattgaaataatatcaagcacattttctgaccacaaaggaataaaactagataataacaagaggaatttgaaaactacatgaatacatgaaaagtaaaaattgtgcccctgaataaccagtggatcaatgaagaaattaagagaaaaattagaagatttcttgagacaaatgataatgaaaacacaacatacgaaaacctatgggacacagcaaaagcagtactaagatgaaagctgatagctctaaatgcctacatcaaaaaagagaaaaaacttcaaatatacaatctaatgacgcatcttaaagaactagaaaagcaagagcaaatcaaacccaaaactggctgaagaaaataaataataaaaaatagagaagaaataagtgaaactgaaataaaaaatagaacaaaagtcaacaaaacaaaaagtagtctttttaaaaagttaaagtaagtggacaaatatttagccagactaatagaaaaagagagaagatgcaagtaagattagaagtgaaaatggagacattacaactggtatttcagaaatttaaaggatcattagcagctactatgagcaactacataccaacaaattggaaaatctagatacaataaatgaattcctagacacatacaatctaccaagattgaataatgaagaaatccaaaatctgaacagactagtaataaataacaagatcaaagccataacaaaaagtctcccagtaaacaaaagcccaagacctgatggcttcactgctgaattctgccaaacatgtaaagaagaaataatatcaatcctactcaaactattctagaaaataaaggaggagagaatacttccaaactcattcttcgaggccaatattcccctaatgccaaaactggacaacaacacattaataaaaaataaaacctataggtcagtatctcttataaatattgatgcaaagatcttcaacaaaatactagaaacccaaattcaacaatacattagaaagatcatccttcatgaccaagtagtatttatctctgggatgcaagtatgattcaacatatgcaagtcaatcaatgtaatacatcaatagaatgaaggataaaaagcatctgatcatttcaattagtactgaaaaaacattttataaaattcaatatccctttatgttaagaccctcaaaaaactgggaatagaaagaacatacctcaacataataaaagcaacatatgacagacacacatctagtgtcatacggaatggggaaaaactgaaatcctttcctataggatctagaacatgacaaggatgcccactgtcaccagtgttatttaacaaagtactggaagtctttgctagagtgatcaaacaagagaaagatataaaaggcatccgaattgaattgaaagaagtcaaatttttcttatttgcttaggatacagtcttacatttggaaaaacctaaggactccagaagaacactactagaactgatcaacaaattcagtagagttacaggaaacaaaaccaacatacaaaaatcagtagcatttccatatactaacagtgaaaaataaaaaaaattaaaaatagtcccattatactgaccaaaaataaaattaaatgcctacgaattaatttaaccaaagaagtaaaagatctttacaattaaaactataagacactaataaatgtaactgaagaggaaaccaaaaaatggaaaaatatttcatgttcattgattggaagaatcaatattgttaaaatgtccatactactgaaccaacatataggtttaatgctcaaaataccaatggtattcttcatagaaatagaaaatacaattagaaaatttatatggaaccacaaaagacccactaccctaagcaaatagaacaaaactgagggaatcacattacctgacttcaaaaattttgctacacaactatagtaacaaaaatagcatggtactggcataaaaagagacacatagaccaaaggatgaatgttgagagcccagaaataaatctacacaccaacggtgaactcattttcaataaaggtaccaagaacatacactggagggaagacagtctcttcaataaatggtgctgggaaaactggatatctatatgcagaagaatgaaactagatccttccctctcaacatataaattaactcaaaatggattaaggacttaaatctaaggccccaaactatgacattggaaaaatcttcagaacattggtctgggcaatttgtagtgcactgggagtgtcataataccttgttttttcatatttcctgtattattatgctgattttttgcatctggagaaatagttgcttctatttatttttgaatttattttgttggggtggggctttttccccctgagaatacaacaatgatgtattttgaatagggccgtatggctttgcttctgagtacattcattgttaaagactgcttaagttttttggttataaatagccttaatatagtggcttcctcaaatgctggtagtagtagcaagagagcttgtgcacagcaaccaaaataacagagtaaacaacaacctacagagtggaaaaaagtatttacaaactatgcacatgacagaagactaatatccaaaatttacaaggaactcaaacaactcaacagcaataacaaaataatcccattataaagtgagcaagtgacatgaatagacatttttcaaaagaagacatacaaatggccaacaagcatataaacaaacattcaacatcatttctcttatcattagagatacgcaaatttaaaccacaatgagatataattttaccctagtcagaaagactattattaaaaagtaaaaaaataatagatgtttgtgaggatgtgaaggcaaaagaatgcttagtaaattaatacaacctgtttggagaacagaatggagatttctcaaagaactaaaaatagaagtaccatttgatccggcaatcccactactgggtatctacccaaaggaaaagaaaatattatatcaaaaatacacctgcatttgtatgttcattgcagcactattcacaatagcaaaaatatggaatcaatctctatccattgatagatgaatgaataaataaaatggcgtgtatatagataaaatgctatgtgtagatacacacatgcacacatacatgtatgtgtatatatgtacatatatacacatatgcaaacatatatataacatggaatactattcagccataaaaaaagaatgaaataaatgaaatcatgtattttgcagcaacatagatgaaactggggacattatcttaagcggaacaactcagaaacagaaaatcaaataatgcatgttctcatttacaagcagaagctaaataatgtgtatatacggacatgaagtgtgtaaaaagagacactggagactcagaagggtggtgaaggatgagaaattacttaatgggaaaaaatgtacattatttggttaatggttacactaaaagcccagacgtcactattacacattatatccatgtaaataaactgcagtgtaccacttaaatttctacaaaataaaattaggaatctttgtttataacagaatgaaaaaaataagccactgattgggaaaagctatttgcaatgcacatacagtaagaggcttttaatagactaaataataaaccttcacaaatatataaaaaacagaaaattcaatagataaatgggcaaaagctcacagattcttcaaaattaaataatactaaaatgacaaataaacatatatagattctccacttcattattattcagagaaatgcaaattataaccatagtgacctatcattatagaactgttaagtttaaaaagactaataatggaacagctggtgaaaatgtagaccaagagaaacttatggatacttcaagacatcgtgttgtatatgataaatacatacaatattatgtgtcaaatttaaaaattaaaaattaaaaaataccatctgagggatgtgagatattgaattcttaatacaatttaaattttcttaatgttgattcagattataatgatgaagataattttaacagtgatttggtgaatgataaaaaatagctagctgttttacaaacggactacttaaatgatgctataatgtaaaagcaaattacacaaagtgagatttaattaaggaggatataataatacctcacattttttgattttttaaaatagaattgtgtttagcagttgaattgtcttatttaatattcataaaagcctgggcaccagacactatcatcaaacataatttagaaataagaaaacccaccaggcgcggtggctcacacctgtaatcccagcactttgggaggccaaggcaggtggatcacaagatcaggagatcgagaccatcctggctaacatggtgaaacccgtttctcctaaaaatacaaaaaattagccaggcgtggtggtgcgcgcctgtaatcccagctactcgagaggctgaggcaggagaatcgtttgtacctgggaggaggaggttgcagtgagctgagatcgtgccactgcacttcaggttgggcagcaagagtgaaactccgccaacccatcccaaaaaaagaaataaggaaatcaagtattacagagcacaagcaacttttcctaatgttaggtctaggatttggaagtaagcagtgtcatccagaatttgtgttcttgctatatagaggaagtcaaaacaattacctaaacaaaaactgatattcaagattttcaaattaggcaaagttttagtaacttgtattgataaagaaaaactgcctagaatatcaataaagatttatgaattttcaggattaaaaggaacctaagatgccattctctagctgaacactatttcatcttcctttggacatcattgataattggctcttcattcatgtgaggctccacacattagaaaaatattcctttagtagagctgaaatttgtgttatgttttggtttgttttagcttccaatgactgaccctaactctgtccctgattaatttgcagtctaatttatattatactgggtcgttctgaaacaattagataaacctatcaagtcatacataatttcttctctaaatatttcctgttgtttcatttttttttccacatggaatgattcctgatacctttcctcagggtatgctcatttgtcaacatcccttattgataaaattggaaaatttcttaggataattgcatatataaagagataacttatgtccaatatctgggacatgataaaatctctcaaatttccttaagaattcaaagctgtgatagtctcatttgtgtgtggagtagtcccctcttgaaaattacaaactttatttgtttttaatttatgaatgtttctttatttttcctttgggacaaagaaagaaaaaagtatgcatgagcactatctttttcaatataagattatttatttaggttatatttctatgaatggaattgatggataagaaatcgtctttttggatagagactaagttgctgtaatgaagaaaatcccaaaatacaatcaatggcttaaatatgatagaagttcatttctccatcaggaaacagtataattaacagggtaaccctgcctcatgagaacttctagggagggtggttttctccatcttgttctctatcaactaataagacattgcccttatcttcatgaccaaaattatatcattgcaaaatctgctttccagtctaaagaaagcatcagtccagaacaagagatttcacttttattataaattgtaactgacctggaagctgcacacgtaaattttgttctcattcccttgaagagaatggattcaaacaagacaggttggttgtaaggaggctgaggagtgtggtctccagctgtgaagccatatgcattgcttcagctcttttcctgtgaaaagagaacaaatcaaaatttagtgtgtcaaccatctctcctacagagactacattcttttgtttccatgaatctcgaaataattttcaagattctttacaaatgattattatctttaaaatattagtaaccatattaatctgtagtgtaaaaatcaaatttttaagacaagaaattaataataaaatcaatatcgtgtggtaagaaatataattgactcattaagtaaacatctcaagttacagaaacagaagggtgtgagcatattagaaatgtgtatgttgaccacaagcatttgtgctgtcacaggctttagtgagtataatttacttaaagactagagagcaaaatttatcttgcaggttttttcaatgtggtcagttaaggcagcttctcttgtaccaacttctctgtggtacatcatatgttgctctgaacaccacattctcaaacatctgcttaaagctgtcctctagtaatttagagctcactctaaatagtcacattatattaaaataagtaattcacatttctcatgtatgctggtaatttttctagtaaatattgcttatattgaagaatcatttactaatctttttgctgttacatgaaaaagtgtttgcacaaacaaggtaaataagtggaaaccaaaatttgcatgtttagtgatttcagaggatatcaaaataaataataatgcatattgataaggtaaccaaaatcattcggcattccttcaattccaatcatagacaaagaaagcttatgctattcatttgtgacattctggattctctccacctttcatgtgcctattcatttttaagttttgctccaggatagccctattgaactgtacaatttctgaggaaagaaagcaatacatgcagcatttcaaatatatccttgctgttaaacccgagatggctagttcgcaactactcactggaacctgacctaggagagttctgtacagcatgcagccaatgggaaggaaaagtctccaccctccaggaccttaagctttagttagtgaagataaaatatactctaagaagcaactatttaccaagtctaaatcttaaagtaagccctgaatcattcatattttagtcccacatccagttaatcacgaagtcttatattctaacttctcatcttcacagccactagtttataatatttccaacagtgctgtcattcgtcccaccagctctggtcttatctcactgtaatactcccttgcagagatttctttcactgtgcaccttaactttgaaaggtatagataaaaaaaataaattattacatacgagtaacagaaaacaacttagataatgagtcagtccacatgcacataacccatctctgaattagtcaatataatatgctcaattacccactttctccacattcttatgtggcatacttactctatgctcttcaaaaaagatttatattttcagggttgaaatatgattatgtcatctccattctcagttagaatattttaaatataccctcaaaattcctaggtaagtccaaattcccttatatggttcttgaagttctggaagtggtgttaccttgctctctggatttagctgtagttattactctccatgtgtgctaaagtatgccatttaaaactatttgtagttatctaactttatattctttcttgccttggggctttggcacatgctgtttcttgcctaaatgtacccacccctttcatgttgcttgtaaattcctccttgtcttccatgaccctagtctaagaactaaagtatctttcttaaatgctcccataaaaccatgtactcatcttatcataacactgatagtactctgttgacattgtcaactccctgtttcagatgtctatgaaacctcaactccctgattacagagactatatttttctcctttctatactgagtggctagtacagtatctcatgcatagaaaatatacgataattatttgttaaattgaaattcacaatttgtggcatagattagatgcatttgtgcctaactaaaaaaaggaggaggtttctctttactaggcattatgctggatattaatgatttcaaagttaatgtgctaaaattcctgtcattccagaacacatcttagtttgttaatttctttctcttccttttttttttttataagtggtcacatttgttattattttttagaaaatacttgggataaccccaaatttgaatccatatctgcattgcaaatatggggtagagttaactggggaaaacttgaattttctcttgaaacaaaattcttatgtatctagtataaataaattgggctgacctaccaaaaagaatacatagcatggaagggaatcaataaacaattgtttgaaataaaaatgactgagtagatttgctggaataaagataatccaagggccaggtaaaagatatgaagtctatggattataagtgggatctgagtcataaaaagagatttggagaactgaagatgttgagtgactgagttttgatcaagtatataatgggttatccaagtagataagcatataatagataatttttctacaagatttataatgagcaattttaaaacatctgggctagagaaatataaattgagaaggttgaaattatagtgaaattttgaaaatacattagaacatctccaacaatgatagaacatttcagagtctaataatttcagtccttaaaattttggttaaatgttcaagctgggatgaataatttggcctttatagtctcgtttaaaagcttcaggagctgcggtggctcaggccagttgtcctggagcataaggaggcgaggctacacattcaaggccaacctgggcaacataaaaacctctcatccattaaaagcttcaaaaattgccacaatctagaacactgtaagattgttatattttctgcatgagagaattttaaaatattatttctgaaatattgtctttatatatttgagagtgatctaaagagttaataacctccaaatctgcatcctcactgaagataaaataaaatgaaatgtgcctttactgaagcagaggagattcgggaaaaattcaatcaaaaccttcccaagttagggatttctactcacatttacttagaacttcaaggaggaaagtttttgaaaatgatataggccttccaatatatagttggaacctttttatgattctattatttaaaaaaatttgctattttaaaaaatgtttgtgggaacatactagatgtatatatttatgaggtacatgagatatttttatacaggcatgtaatgtgaaataagcacatcatggagaatggggtacccatcccctcatgcttttatcctttgagttacaaacaatctaattacattctttaagttatttaaaaatatacaattaagttattgtcactgtagttttttgagaagcctccaaactgctgtccatagtggttgtactaagttacattttcaccagcagtgtacaagagttatcttttctccacaaccttgcaagcatttgttacggcctggcttttggatacaaatcattttaactggggtgagatgatatctcattggagttttgatttgcatttctctgatgattaataatgttgaacaccttttgatactcttgtttgccatttctatttcttcttttgagaaatgtctatgcaaatcttttgcataattttttattagattattagattttttcctataggcttatttgagctccttatatattccggttattcatccttgtcagatgggtagttttcaaacatgttctcacgttctgtggggtgtctcttcactttgttgattgtattctttgctattaagaagctttttaaatcgatgtgattccatttgtccatttttgctttggttgcctatgcttgtagggtattgctcaagaaattttttcccagaccaatggcttggagtttccccaaggttttctggtagtagtttcatagttcgaggtcttggatttaagtctttagttcatctttatttgatttttgtgtatggtgagagccaaatatctagtttcattcttttgcatatagatatccagttttcccagcatcatttattgaagtcttttgccccattgtatgtttctgacatccttgtcaaaagtgagtttactgtgggggtgtggatttgattttgtgttctctattcttttccattggtctatgtgtctgtttttatgccagtaccatgctattcttgttactaaagttgtgtagtaaaatttgaaatcaggtaatgtgattcctacagttttgttctatttgcttaaagtagctttggttattctgggtcttttgtggttccatataaattttaggattgttttttctatttctatgaagaatgtcattgttattttgatagggattgcattaaacctatatattgctttgagtagtatgaatattttaacaatattgattctatcaatccatgaacatgaaatatttttccattattttgtttcctgttcaatttctttcattagtgttgtatagttttcattataaaattatttcactactttggttaaattaattcctaggtatttaattttatttctggctattataaatgggactatgtttttatacttcatgctgttgatatgatagatcatgttgattgatttgtgtatgttgaaccatccttgcatcacagggataaataccacttggtcacgatgaatgatctttctaatgtattgctgaatttggcttactagtattttgttgagcatttttgcatcaatatttatcagaggtagttttctttttttgatacagttttgccaggttttggtatcagggtaataacgttcctcggagaatgaatttgggagcactctctcctcttctattttttggaatggtttgagtagaatttatattagttcttcaaatgtttggtagaattcagcagaattcagatgaagccatctggtcctaggcttttctttatggggagggattttattatggcttagatctcattacttgtcatcagtctgttcagggtttggatttcttcctgtttcaatcttggtaggttgtgtatgtctaggaattcatttatttcttctagattttccagcttattggtatataggtgctcatagtagccactaatgatccttttaatttctgcagtatcagtagtgatgtctccattttcatttctgattttattaatttgtatcttctctcttttttcttagtctggctaaagatttgtcaatttaatttaacttttcaaataacctactttttgtttaattgactttggaattttttttcaattctatttatttctgctacaatatttatcatttattttcttctactaattttgggtttgatttgctcttgcttttctaattctttaagatgcattgttagactatatatttgaggtttttttctctttgttgatgtaggcacttaatagctatcggacttccatcttagcatcgcttttgctgtatcccagaggttttggtatgttgtgttccatcataatttgttttaagaaatatttcaattttcttcttagtttcttcactgacccactggtcattcaggagcatattatttaatttttgtatatttgtatagttttcaaaattcatgttgttattaatttctagttttattccattgtggtcagagaagatacttaatatcatttcagttttttgaatgttttaatccttttttttgtgaacatattgtttatacttgagaataatccaggtgctgagaagaatgtgtattctgcagctcttggatgcaatgttctgtaaatatctattagattcatttggtctatagtgaagattacatctgatgtttctttgttgattttctgtctggaagatctgtccaagatgctgaaaatagggtgtgaagtctccagctattattgtattggggcctatctccttctttagctctgataatatttgctttatacatctgaatgctccagtgttgagcacttatatatttaaaactgttatatcctcttgataaattgatttcttatcattacatagttaccttctttgttctcttacagcttttgtcttgaaatttattttgtctgatgtaagtacagcaacttctgcttttttgttttccattggcatggaatatctttttccatctctttattttctatgtatgtatttgtaggtgaaatgtgtttcttatagacagattaatgagacttgttttttcatccattcagttactctatatcttttgattggagattttagtccaactacctcaatgttattactgaaaagtaaggacttactcctgccattttattattctttttctggttgttctgtggtcctctcttctttctctctttcctgtcttcctctagtgaaggtgatttcctttttgtacttggatattgatatatttctgtaggtttcagaagttgcctgttattattcctttgaataaatttgctccctctatttatttatctacctcttctttaaggccaataattcttagattttcccttatgaaactattttctaaatcctgtaggcatgcttcattttgttattcttttttcttttgccttttctgactaggtattttcaaatagcctgtcttcaagctcactagttcttgcttctgcttaattctgctgttaaaggaacttgatgcattcttcattatgccaactgcattttttaactccagaatttctgcttgattctctttaattattttaatctgtttgtctgatagaattttgaatttcatctctgtgttatcatgaattttctttgagtttcctcaacctacctattttgaattctctgtctgaaagatcacatatctctgtttctccaggatttgtccctggaaacttatttagtgttcatttggtgagattaagttttcctggatggtgttgatgctagcagatgttcttcagtgtctgggcattgaaggattaggtatttattgtagtcttcactgtctgggcttatttgtactcatccttcttgggaaggttttccagatatttgaaaggacttgggtgttgtgatctaagctgtatctgctttaggggggaacccacatccagtaactctgtggttcttgcagactcataaaggcaaccccttgatggtcttgaatgagatctgagagaattctctggattaccaggcaaagactcttgccttcttcctttcttccaaatatatggagtccctgcctctgctctagccacctaatgctgaggactggagtgacacaagcccccttgtggccatcattaatgtaatttcactgggccagatctgaagctagcacagcactgagtctggctgaaggcttgctgtagccactccctgattactgcctatgtttcctgaaagcacttgggctctctaatcagctggtggaaaaaccaaccaggcttatgtccttccattcagggtagcaaggtcccccagacccccagtgggtccagaggtatcatcctggagtctgcccttttttaaattaaaaataagcaatcaagaacagcaacaacaaaaaattgccagagtaaacatcatctttatcttaagcaatgtcagagtggaacttaaaacttagaaactggaacttagaatgccttattgaaagaagaacacacatatggacttaaaatggtaccaacagagagaagaccaggaaaaaaaaattaagttcataaactactctttgcattttgcttttatttaagaattattccttgcttctttcaataaattttgattgtgtgagttttcaattctccagaaattgaaaataacataatgtgctcactattcatgattgcataataaaaccacttgggtattaaaaaaataataattccttagctagaggttactgaatgacaatagaaaaaagaagaaagaatctacataagtggagacagttctcactctaagctgctgaatatgctttctgtttaactaagtaaaaagaagtaatcaaaaaacaatttccacaattttttatgaccatattcacctacctgcctctgtatgtacatactgtgttctctctcttgttctgtagatgagccatccacatggcaagcaaagggcagtctctctactatgtcccagatctcattcattcttgcctagacaagagcaatttttctggaactctctcttttctctcttgcattcttttttttctcatgagcatattaaaatgctgctatttcactctcatttgaaagtaaatatagacatacacgtatgtgtatgcatatatgtgtgcatgtgacttcaccataccctccagttactgtcccatttttttctttatttgttttacagtaaacttctcagaagagttggctatattcattgatttcagtttctttacacttgaacctgtttctatcaggcctttgccaacactactccactgacgtagctgtagttaaagtcaccagtggcatactctttgctaaatcatgagattgatagtcatttaacctatttgggctatcggcagcatttgcatagctgatcactcccttctcctagatactttctttgcttggcttctaggacacaaattcctctgctttccttctccttcactggtctcttctcattctttttcatttattcctactcatctttcatatcttttggagctcagccctttgagattcattcgtaagtaagaacaatctatctcactgctttaatgttcatctagatgctcataacttctaatttgtatattcaagtgactgcagaacagagaagtaatctcaaaatatgcacctccaaacccaaatgcccgctattatttactactttgctataaccttttctatttccactccttattcaataagaagcagctcctttccataaggcagctccttatttttgattgtttgggccacaggccttggagtcacatttactctactttttctctcatctgctgtctaatctgttaataaatcctctaggttatgccttcagaatatttccagaacttttatcctctcactgctgcattgttgcctctgttactaaaatatgagttagaccatgcctctgtggtaatcaaagccttcagtggtttacttttaacccagagaaaaagtcggccatgaaaaacatgtacaatctgcctgctcctcctcctcccactccccactcttcacctgtatgatttctcttaattttcctcctatttacactttcacccagagtcttttcattttctcttccatctgtctgaatgttcttctttcagatatttgtctgtcattccccatttcctgcagatttgagtctccttccctgacaggcctccactaaccacataaaatttctaccttccaatttccttttctcttcctcttctacacttttctccttaccatttaccactatctaacaagcaattttaactttattcactttacaaggagttctgactgttttacccactgacatatccctagcactgagcttgtggcacattttaggtacacaataaatatttattgcatattgccatattagaattactgatgaagacccaggaggctgtctttaaaggaagggattttttaaaatgaaaatgttagaaaaggtttcgaagaacaagttgcatttgaattgaggttagattaaatgataggtaatatttgagtgtgtggatgagggaaaggtacctgtggtggtgattactgagtgtgaaaagccaacgatcctcgaaaataagacatctaccaagaacaccgtctttcaatttgggtggaatttggaaggcttgaaaagaagatatgttcaagttactgggaggtaacttgggatgtataagataagcagaaagcctatttgggtcactgaggttaagcaatgaatttcttccctttcttgagcaaacaggcagatccttgatatgttacatttagatatgtgcagtagctttaatatcttcttccagaattcttccagtgacagtctttctgcttatcaagctggctaagggaaatcaaatcaacaaacctcatttcttattgaggtgggccagatacttattcatgcatatttagggaatataaatctcagttccagaatgttcgaactatagactattctgcataagccagaacataattataaacatgtagaaagaaaccactttactccaaaggtgtataatctatacatattttaatagaatttctcttttatacttgggacctaaatttgagtttagaaaaagcaatcagtaaacttacataatgagatttaagaggaaatagtcaagcaggaaattcctctcccgagcaataatttttctacttctcaatctgcacctctttttttcctgcctgactcaaaatagcaaaattctagccttaattctccaggacccctgaaggcattctcttctaatacggtgttttttccttttggttcatcttccatagctgttttgagatcagaggccttggcttccatcaccgcctggaactgacttccctcaccacttttaaaaatcagagataaatagtgaattataaaaatatgagtaaagtcaaaagcaaacactggaaacatgatcaaatacaacaagaacatcaagtgaagtacttcaaatagcacttcaggtctgtatatgtgattagatgagtttatttttagaataatatattcattgaccgggcatgtgttggcctgtcacatgctatagattattagactgacaataacccctatgacttaaggatattattagtgttagctttcaattctacttatataattattaatgattattactgtaattataaataattatttattgagcacctactatatgttaaccacttaatatgaattatcagatgtaatcttcacaacagccctcttagttaggatatattataatttccatttgacaaatgaaggaagtaaggcaaagtgatgttaagttacctgcccaagatcacaaagcaagaggtgtcagacccagaattcgaaggccatctgatcactacagcctgatttcagagtgtagagttttaactattccacaattctgcttactttcagtaatatacaacttcttcagttattaagaagtaaaagtgagagctagctttaatcaggtgcctatacaccagacaccttgcattatttcctttaatctttgcaacagttctacaaattagaattttataggtgagaaagaggttaatttagttgcccaaggtcgttctctccaaaaataaagttctattttccttaaaaacatattggaagattgtcatgaggtcaataatgttcagcaggcatacttctgcaaaatcataaaactcatcttatttacttagtaaaaccatggctaaattaagaaagagataaataaaggtgcattccattatttttcccactttcaaggtccagctcaaatgctgtattttctaggtctagttccttcattaagccttcctcaattccctgatccccaaaaccaactaatcttatatttcaattcaattaaggagaagcaagtctaatggattgggaacagatgtgcatatttttaaactgctgttgcttactgtggaagtcagacctattaaaccctccattttaaaaacctttaccctttacattctgattattttatggtacatattctgcttagtagtagtgttattgtgttgttcttattctgtcttccaaatgataagcagatgataagcaaagacttttatattcattcattcttatatcttctgtagtgtttaatacagtgcctagcatactgtatatggtcaaaaatggttataatattgatgtcagtggataattcaatgatcccacctttgattagcaattttttaatttaataatctttaaatgcctagaattaatagcaccattctctcagcttctatacccaggataatttctggacacttctgatgactttcccatgatctccggaaataataaaagataagctttacagatgaggtaacagatttgcaaaatattaaatatgccattacctgaagagggcgtaagttgagccctttccttcatctctttcttgctcacagatattacaatatctgtgcaaaaatcctaatgcaagaatgagcttagcatattccagggactgtcattaactgaaatacatatataacaaggaggaaaagatacaataaatgtggaatttattctaattacaatggaaagcaagtggagagttttaagtaataagttttatgctttaaatttttttggctgctgcatggaaaagttccttgaaggagaaaatgtgaatagagagtggtgggaatggcagaggactattgcaagagtccagttggttgctgatgttatcttggactagggttatccgtgtggaaatggtaagacaaggtaatattcagacttgccagtgtactacctgtgggtgtgaatgacaaatgtgagattcaaacccaggtctatattgcactaaagtttacaacatttgcacacctctatattccctcaattgggtatcttgtttactttttaaaaaaagacaatataaaacttataagcctagtttttcttcaggttactttgttgctttctgatttaccattcttatcgccctaaaatctaaatgtaattttagagaatatagttatacattgaaaatataagagcatgcatgggtacatggaaattaagtatcttgagagattatatctattctcaaatttacccttgacaatgcaagcagttacaccaaagagatgaaccaattactgtaaacaagacagaaagcacgtaatctttatcttttttctttgtataaataacttgcagcattccagacgtctctctcattgcaaattgatataaccacaaaaggattttgagtataatttcaaggaacatttgtttgcgatcatgcttcccacctcccaccaaaaataataataaagatcatggctagaactaacgctccaagaggtacttttaaccttaaggaagtgtagactttaaaatctattagtgaggcaaaacaaactttgtttcagctagtgctagagaaatcagacccctaccactagagaactataatgcccattaaaaataaaaattaaacacaaattgtgacattaaaaaatatgagtgcctgggtctcatttccaaaggttctagttcaactggtttgagatgaaactcacgaagcagtatttaaatttttttctcagatgattttaatgtacaaataagattgatgagaacagggcttgaggaaaataaattatgttgtcttttttttataatatcttaggatgggaattcatcctcattttccaagttaaaataactgtcttgctctggcaaaactcagacagaactcatggaaaatacaaagttttcatctgtgtgtgtgtgtgtgtgtgtgtgtgtgtgtgtgcatgcacccagaaacacacatgtaagcacacatgtagcaatggtttaaaagaggacttttagagctctacagtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataagagcattacatagttaggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaatagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattcttatttgtattctcatatttaagagtaaaggccaggcacagtggctcatgcctgtaatcccagcactttgggaggccgaggcgggtggatcacctgaggtcaggagttcaagaccaggctggccaacatggtgaaaccccgtttctactaaaaatataaaaactagccgggtgtggtggtggacacctgcaatcccagctacttgggaggctgaggcaggagaattgcttgaatccaggagacggaggttgcagtgagccaacacagtgccactgcactccagcctcggcaacacagtgagactctgtctcaaataaataaataaataaagaccctaagacaaaaaagaaagataactatctgcagtctagagatgaaaccaccttaacagttttaattatattaggttgcattttcaagtgtcagattgtcccaattcatacagtacttttactagttctcagaatgatctgtatagacagtaccatactgtgtcagttccctggcatgggataggatgtagtgaaaaaaaaatcatggaagagaaaataaattattcaagctccagttactaaattccccagtcacttaaccttttggagaatcaattttaacatcggtaaatgtaaggatcactatgaatgctttacctatctcatagatcagttgggaaagtccaatataagaaacatagatctgaaagtggctaagtgatgtgtaaaataatagtttttctattttgcaatgtataatcatggtgggtctaggattgagtctgacactgtccaaatcaaagttctccacttttctctggattacatcctctgctttttcttctggaaatttggtgtattatgattctcctaaattttcaatttctcaatttctaatggctatttatcatcagcatttaaacataatcctaaatttactgtcttaaaaaagagtctttaataattataatcctttttggctatcagcatctctctcctcccttttagagctaaactttcacaaagttgtctatcccaactttcttcatttttatgttcctttccccttccacctcaagcaatgtgaattccaacataaccatctataaaaacagaaatttctctcaaaaattaccactttctgaaggctacatcttctttaactttttattttacattgtttaccaattccttcttcctgaaacacttttgtgggggataagtgtcttccatgaaactgcattttgctacttttctttctgcctttttatctgtttgtctcggtctttttagaagcctccttctcttctgtttatcccttaaagattgacattcttcagaacttaccataggatcttcatgctcttcacctttactttcctcactattaaaatcacatctatttgcatggttttaatacacagcatgctctttcattcatctcagtttattttctcctggacttcagatgcatgggcatatccaattgcttattggatatcttcactccaatgtttcacatgcaattcggactcatcattgttctccactgcctacctcttgtctctctgtcttaatgaatgacatcataatcttctcagtgactgatgccaaatctgagttttatcttagatttctcccttccctcaacttccacaacaaattaataatgtgtcttgccaatcctacttcttaaatatctctcaaacacatcttcatcttttgatcacatcaccaccattttggtcacaactatgtctcatctaaaatactgaaaatattatccaacctatggtagcacaaaagactgactgcagtgtgtttcatggggatgttttggcatcctcattatattaattatctatcgccatataacaaactgacacaaacttagtgccttaaaacaacacagactcctactttacacttactgtgtatgtaagaattgggtatggtttagctgagttccctgctacaggatctctcacaatgctaaaatctagacgtcttatctcaaaactcacccggggaaggatctacttgtaagatgatgtagttgttggcagaattccttttgggttgatgcactgaggaccttagtttcttgatggctgctagtcagaggaagccctttatatcttgtcatgtgagcccctccataatgcagcgtgcaacatggtggcttgttttatcagaactaacaagggatagagtttgatagcaagcccgaggtcagaatcttatgtaactgattcacaaaaatgacatcccatcatctttgaaatattttattggctagaagcaggttatagaccctgtgcacacacaagaggaagacgctgcacacgaggataaataccaagaggcagaaatcaccggaggccatcttggaattgatctgccagatttcattattcctttctgcttcttaaacttcccacagcagcaaacaatgtaggtaaacattgttgcagtctacacagatgcagttttaaggaaaatccctgaggatgcagaggtaggtaataagaccctctcgtgtacttccttattatcctttatttctccttacatagccctacattgtattataattgttgtctcacatgtatattagatagagaccttggttatcatattcatcacaagtgcccagcacagagtctgctgtatagtaagtgttcaaaaaatatttcttacataaataaccccaactaaataaaatgctatgtggcatttttgctctctgtggtttacattcaaaagattgatagatccctcaaatgaataaccttaataaaacaatactgtctttatcaccactgaatttatctaaatccctctagaattatttatggtttttgcttctatcctccccagggttaatgggtactattccttaataactccatctatttgctctaaaattacctctttcttgactcaagaagatactcaatttctgcattctgatttttcaataattaattctatatttatacttctgtacccatcacaaggttgaacattacaatccaaacacttcctgattaaaatgtttcagccttattcttctgttttcatgtagaaaatgcccaatccctttggtaagttgcctggatcttctccaactgcatatcttctttagggtacaatgatcagcacttcacagttttgtttaaggaaagataaaattcgtaatgctaagttgagatacaaaaataaagatggtgccatttctcctagatctttataataaccttagttgtaaggtaaattagtggctgggctggcatgaagtctgaaatattggtttggatgcattgaatgctaatggaaaaacctgctccaggtagagttttgtgatagagtttatcttctgtgaactttattactcttttgttaacttccatttgtccataatatagtccctccctgaaggttccaaggtgcatcagaccttttttaaagtaccttatgactactaaccaaatgataaaaaactaagttggaaaatgggattggaaccagttacaggggaacatagatcccagctatgccatttgacccagtgctgataataaaaaaagacataataccaaactctgtaatcctgaatgttgaaatcccaaaagattaaattccttaaatctgaaatctataacatctaaaatccagaaaatcaccatctcggaagattaaaatcacaaatattgaaatcctgaaagccaaattctatggaaggcattagtgcattttcagttgcacacaggatagttgcatcatgttagttgcataatgttaggtgggacaataatattaccttgttattgtctttatttggaaattaagtatgatttaaggagacatgtatgggtgccaagttgacaaggagtgaacttgtggacttaattgtctgggtcaacttgactagattaaggaataccaagaaacctggtgaagtattattttgggtgtgtctgtgagagtgtttccagaggagatcagtgtgtgagtctgagcagactaggtagggaagatccgctctaatttgtttcatgcatgttttgcaaatttgattccacgaaagtgaattattacaatgtttactttttgtgtaagcaccatccaactggctgagggcctagagagaacaaatacagaagacaaactgatctctgagagctggggcaaatttttctttagcttcctaggatgtcagaactttgggctcaccggcctttgaactccaggacttacaccagtcctcccaaccaggtcctgaaactttcaatgctgaactgagaattacaccattggctttcttgtttctgaagatttcgaattttgattgaaccatactgctggcatccctgggtcttcatcttgcagacagcctgtagtgagacttctcagcctccataatcacattagccaattactataatgaagtccttctcatgtatctatatatcatcttggttctgtctctctggagaagcctgatgaatactgatttggtatttaggaaatcaaatattattccttcttactgtattttatttcttacaacataatagaagagatttgtgaaattgtttcctcacaaggaagctgtaatacaataaatgcatgaggctactcaatggtgaaacacaaaatttaaaagctaattgttattggtgctgcaaaagcagaaaatcacttagttacaatagctgagcaataaccagcccaaaaatggacagcatatacttacaaaatttgtagaccacaaccacactccaaataccagtgcagcaagtgttttgaagatcccagaagtgaaaattcaggtgaaaaagacaagaaatccctgccaaacaatttaatctgtatgacttccgctcctttacacaaaattgttgttatatatttcattttagcatcattttcaatactggaatttaaaattgtataaataattttaaagagctctaatttgtttcatgcatgttttgcaaatttgattccacgaaagtgaattatcacaatgtttactttttgtgtaagaattttgcatatatgtaaaaacactgaaaacttcttcagtaaatgaaggaaggttcttcttttatatctgcagcttttgtgaaagataagatttctctttgggcaactgcacatgccgtggtgacccatggcagtttttgatggatctcatcaaaactcaggttgcttgtcgtaatatttcacatgaaaatggttacaaactggatgcatgcaattactaaccatagtcatatatgtttatacattttggtttcagacttatgtcatatgaatacagctcattttctcataactgttatatcagtgtgactatcattagtttccctgagtgtttatgcttgtgaaaatgttttattattgcctactttattgtgtaaagtggcccataaagtgttctgtcatgtttttatatgtttcttaagtaaatattcttttaaaaatgagatacattatattttaaggaattaaaaaatttgtttttagaattatgttttccagattttgatctctcaggatttcaacaatcaggattatgccttatggattatggctaaaatctgttttggtttaatcccataggctgtgaggagccattgagagttttggtgcagaggaatcacatgatgaaaactgagcatagaaaggatgaaaaatgcatttagagattgtcactataatttcaggaagaagtaaagaggctgaagaataatgatgatgttgacaatgttttaaaaagtataaatatggccaggcacggtggctcatgcctgtaatgccagcagtgagaccccacctctacaaaaaataaaaagtgcagtggttcatgtctgtagtaccagccactcaggaagctgaggtggtaggattgcttaagcctaggaggttgaggctacagtgagtcatgatcatgcaactgtactccagcctagacaaaagagcaagactctgtcaaaaaaaaaaaaaaaaaaaaaaaaaaagggtacaaaaatgttatagtatgaacgtattgggagaaaggacattcatattggcttacagattttgaacctggataaaaatgtatccttagatagaagtaataagttctagtgtttgatagcacattagagttttgatgagatccatcaaaaactgctgtagttcatcactgcatatgcagttgcccaaagagacaagatcctgagaaatcttatctttcacaaatgctgcagatgtaaaagaacctttcttcatttattaaagaagtttcaatgtttttacatataggcataatgcttacacaaaaagtaaacattgagctaatgcactttcatggaatcaaatttgcaaaacatgcataaagcaaattataactctttaaaattctttacacaattttaaattccagtattgaaaatgatgctaaaatgaagtacataatagcaattttgtgctatgtgtagaggagcagaagtcatacaagattaaattattatttatttatttatttattattttttgagatggagtctttctctgtcacccaggctagagagtgcagtggcgtgatctcggctcactgcaacctctgcctcccaggttcaaacgattctcctgcctcagcttcacgagtagctgggactaaaggcgcacgctaccacacccagctaattttttgtatttttagtagagatggggtttcaccgtgttagccaggacggttttggtctcctgacctcatgatgcaccagcctcggcctcccaaagtgctgggattacaggcatgagccaccacgcctggccaagcttaaattattgaattaagaaattacaacagggaaataatgacagagaaaactagaggaataattagcatattatttaaatctatgcaaataagatttaaagca

SEQ ID NO: 865 - DNA, 108575 bp, Homo sapiens
gctgttttgtaatttttacatggattgcatatgtagttcatctttatcccggcactttccattacgaaggacaccctcagagagagacaatatgatcttccttgagccctacatgtaacacaacttggaacccaaccatgtcccctatctagtggggcctcaccatgcttgtctacttggaaaatccttatacaaagtgaaaaattccttcatttgtttactttatgtgtgaatatttgatattggattttcacaaaacagaacacatctatactttacttgaaactgtaatacgttttactgctaaattcaattttattaattctaagagctgtaaatttctttgtattcaatgaattttaaacgttgcagaaaatctattactattcaaaaagaaatagtttttcatttaggcttgctacaagtgtgtccattgtagcatatgcagagaaaatcagtctgtagtttattctgcatttgtctatatgactaaagttgaggtctcattacttgcagagccaacattcaataacctttcattttgagggtgaaagaagtaagatacagcaatgatctgcctgtaagtgcatgtcaacactactgcatatggataaacacatttgaattagtatataggaagatggccactaaaatgcattctatgtcaagtggtgatgcataagcttgactttttaagaaaattctacttgactgagctcactgtgccaattggatttcatggtgtgccctgagtgtctgttggtttcagcttccttctatcctacatccctctgcattttcagctcacattggtctgctattctcctttcttggcacacgatttatagccttccctctttctcctttatcaatattccttcccactatctagttgtgaggctgtacctctctggctctctcatgttcctagaacataagtgaaactttggttcaaggcaaacaggaatgcacagcattgtacaacaaaacccttgtctttcttggaataacctgaagtaaataatttgtatgaatatcctacataaggaaataaaacgtaattccccatatgaagtaagaaacacataggcaagactaaatgaaaaatcttcttacccaatttgaagaaatggaatttatctgaatgtaatcatgttctaggctaaaattatgaggtgctatgtgaaattccacacaaatgaacttggaaatagatattgttttacttggtgttctgcccaggattttgccaaaatttcaaagaattaacggaatttaacttaatattatggcatggcagagtttaaagaatgcttctctttatccattcctatttctttcccttccagaggggaagacagatgcagagttactgaggatcatctgaacagtttatgttggtgtctcagagatatgttaccttccctacactcaatcttacttctctgaatatgtgctgtagcgcaccatactgatggaaaatgctcatttctcccagttcccagaggcctttttaatttcctatctcaccttttaaaaatagcaagaaataagaccatgatgcagaactcttattagatgtttttccaaatgccttggggttcaatgatggtagttggaagcctgccagtgtagaaaacttacactaggttatgtatgtttgccagataccttgtgaaatcagttaccatttaaaagacgttttttactatgaattcctccttatcaattcccaggcctctgactttccagacatttttccaatgtctgccttagagaacactatactgtttacaacatttctatcccacctcctgaactcgtttcatcagacatctcctgccctaggcatgaccttgacatataagtgtcttgttcagccaataagtgtttgactgcatggtttgtatccacctctgtgccaagaactgtcacaagatccaaagaacaacaaaaacaatcatagagctttccgtttattttagataggtaaaacgaaagcttacaagctaattggagaattattaagaactgaactatgagaatgaaggcaggtaaatattactgaagaataaaagagtcatcagtttatttgaacacctttgaggaaattcacagctacaataagacatgatctgcagcctgaaagaataaacagactggtgaatgaggaaacaggaatgggcattccagatagggaggcaagcatgagctcagtggttgaaataatctctgagtctcatgggagtccaacatacatattagtgcacagggaagtaagtgtggaggacaggcagagtgccctgatcatgaagggttatgtactagacggtggcatttggcacaaatgattttaaataattactgcaatagccatattcttttggtctctctctctctctgcaaagccaggaaagtttctttggttttaaagattcatgtgattagattgtgcctacctaaataatccacaggaatccccccatctcaagatccataaccatagttatatctgcaaagtatctttttccacgaaaggcagtatagccataggtttcatgcattaatgtatggacatcaccataggccattattctgaccatcacaaattgtcctctaaaaatttattgaatctctgcatttgcttgtattcccctcctattctcctgtgtaatgtatatacttttatattattttatgatcattttactgtggttctgtgaggaaaagaagctaaatgaatgagcttagtttggcatcttgaatcagaagactttccccaggagtttcttttgttcattatttgaaaaccattgtcatatagtcttgagtagggaaatgacacaataaaactttttatttttaaaatacatttttaaaattatctaacatgttcatcatttttattgttctcgtatatctttatcattttaaagtattctatacatgttcaaatgctgacactcttttttgtatttgtgtgtgtgtgtgtgtgtatttatatgtatgtgtctatatgtgtatatttctatggggagattttatgttaaagtggtatcagttattttgctagagaaaaaaaaactttctttccaaataactttcaaattgaggaagaaatatgatttgtcataaaatatttagtctaaccttacagtttaattattttaaattttttaaaagttctcattgcatattaaatttctcattaggaatgatgtattttctgtagttcagtaaaacttcaaaatactctacataccaaaaactattatctcccaaactgtattccacaaaattctatattcttgtgtgaagtgagtagctcttaggaaaaaaagccattctgtgagcaaataatttgggaaaatgattaattgtactacctttctctcttaaatatttttaaagtatattaagataaattatacagcaaaacgaacatttttaaacctttggtcagccccaaatattctacatatatttgatcatgtttctttttttttttttttaatttgaggattatcccttaacagctcatgggaaactatagctcagaaacagtttgaaagtgctattgtagcccatatctctaatcattttgtgctaaatattttggctttattatacacaaatgtaataaagggaatgattacccagacagtgttacaatgaaagggaattagaacacgtgctccgaggcatgcagtcaagccctctgctgtccttcctctggttccctcactagctgacattagtgggttgtcatcgctttcctgagtcgtgcatctgagagctcagcatggacttctgcaagtttgttgagattactctatggccaacagcccatttcccctattcattctgctcttctcttctaaggatgctaacacagtgttaagatataagacacatcaggagaaagaatgtagtagggcacaaaatgctttcttcagctcaactctcatctgtagacatcacttcatttgactcagtgagaatacacattatcctctctcccaagtgaccttgtgaagagggttcaaagtcagtttagtaggtatttatttgcacctctccttctttcagaaaatacttcaagatattttcaaaaatgtgtaaattgtaacaatatgttaacatgttaatctaacctacatacttaccattcttaggcccttattttgtgctatattttccagagaccaagtgcaaacaaggaatctttgtcagttaacaagtgtcacaatatccactggattaaaaaatatatatatcaattgcttaagagaattacaactattctttgtactagaatcaggcacaattttatctgggggctttgtaaagagagctctttgatgtttagtcaacagcattctacaaactcaaaaaattccatagagatgttttgcataacattgtcaataaaaattgatgtcttctcacctaagcataatttagtaataataataataatagtgtgtgggttttggtaacaataataatttgtgtgtgtgtgtgtgtgtgtgtaggggcatagctttaacttaatactaattaggtggtcagctcttggctgaccttgaagagagttgaattctcagcacccaacccattgccctgaatgtagcaaatgccaataaatcttggttgaaagtgataattattcttcaaagggagcacataggaaaatatgtatgtgaatggtttttctatagagctcacacaattattttgttctacaaactacagctgtcctgaagcctagacctgtgagaatggaagaaaagtatgtctggtggccaagttatgagatgaaagattgctcctcagtttgggccagcccatatttaataattgcagtttccaaagcacaaagttaatttttaaaatatatctctaaaatatatctctaagatgggtcttcagatttacccatctcccaagtttaattctgtttattgctgatagatgtaatattcctacatggtaggaactcatacataaagaaactgagattcagaatagttaagcgtattgatgtaattcattaagctagcaagtggcagaggtggaacttgaacccaactctgtcttacttcacatttcatgattataatctactgttttgtgctgaaaaagagcctgtagggcttgaactttacgttttcccttacaaagaaagagcaggaaaggacactgcagacagaaggagccattaaaacttcacagtcaataattctggaaattcagatattttaagtctgctctgatgctccaggggtctcaaaccttatttcagctgtcatgtgagttgacctttctcaatgccagcttttgtgtcatgcttcaaggacaacaagtctgatgtaccttttgaatcccagggacactgactttcacaggaagtagctacgtcttttcatttattttgtgtgctcttgagtggtatttaagttgacagccaagtcctcagtcttcttctcaagggattataggtgttgaactactttcatctttcgctgtgcattttctttaactgataaaggatcaagaagtatgtgaatcctcctctctccccagtcatcccctagcattctcggtgacatgttagttggaaaatcacactcccacagtggtggttagataattgaaattcattccagcagggagaaaataagttctggaggcttatttctttgcagattctttattaggattttgaaactgcatcttcactagtcaaattgcagagaattagaggaggggaatggggacccctggaattttccaaagtgagatgaatacaaccaaattctgtacttctgagatggcctgcatacactacacatatccctctggtatggtgttctttagatgttctttttgatgccaagccctcctgcaaagcatctttagcaaacactatttgaggtttagatgtattgtgttcatattaatgtgagcgcttatggaacattctttttttttttttttttttgtactctaagcaggctgacaaccacattaccctcttcttcactgtttcctacataattatgtcaggcacacattttaacaggatgtatttgtcaatgaagatgatctatctctttttttttgtaagaaagctggcttaaaagaatatgatctcttctgacaaacataaggctaacattagctggaaagagaatgtctcattttaaagtctgattttctgattccttgaatatagtaaacatagaattaagtctacactcacaatgttaaaagaatttgagaaatatgaaaggtataaagacattgttaatattctttgtgtctgcatatgatggccctgggacagtaaagggatcataaaaagaaagaaaataggtaaaagaggtctgcagtataaactggtaagtttgtaaaatctatgaggtacatgttaagtatcagtttctattcctcataatttttagctataactaagattcataaaagaatgataaatgacatgtaataggagatggattttaataaagagaaaatgtttgtagcaccaggggtataaataaagttaatatagaataatagcgtatttatatataaggcaagatgtaatggaagggactaataaatgaagtctttctgatatttggattacttcacaggcttatgtttgcaaaattagaaaccaagaatctgattgattcaaatatattatagtaagattcagacattatccagaaaaaaaattctcataaatctgcattaactttttatccttgacttttatatcatatatagttaactgggttgctaaaattccatgacatcactgagaaagtggcaaggcaatcagaactttttaagtgtacatgcctgacattcaattaaaaaattaacaggcatattaagaaacaaggtaaagagaaaaatcagataatagaaatagtaattagtttagataatccaaatattgcatttactagatatggactttgagtgaactatgattaatatgtttaagaaaacacatactaaactgaagtaactggccagagaactgaaaaacataaagcagaataaagtagaaaacctaaaacttataaaggcattggcagaaaattaaaaatcaatgtaatgatttattacagttgataagacacagccgaaaaataagaattagtgaactgaaagatacgtcactagaaaatattcagactgatgtgtagaaagtaaaataatggaaagtatataaaaggaataaagtatatacgaggcacagtgagaaggcctgacacacatgtagatagaattctgagacatatacacacacacagaaagagagagagtgtgtgtgtgttttgaggaagatattatttgaagagacagtgaatgtaaatttttcaaaatgaacagaaaaaaatagatcagagattcaagaactgttgtgaacccctagcaggataaatagtaaaatgttaaaaaaaaaaaaaacttttaaagataatatcttataaactacacttaataacaacagatcagccaaaaacgactactgtcagcagaagaaatggaagctgttaaactgtacacctttaacatgtcaaaagaaaatcaccgtcaacctaaaatgatatgccctgtgaaactgtctttcaaaaaataaggcaatcaaaaacagaaaaaaattaactgacaaagtgatttttcagtagaaagaaaataatgttaattgaatctcagaattatagaaaaatggagaataataggaagtttaactatgtgagtaaatggaagagataattcactgtttacagaataataataaaacttgcagacaaatatatatgtagaataaaaatgcatggtaacaatggcataaaagatgagaggagaataaatggagtttaaagtttgaaggtccaaaaattgtcagaaaatggaaaaatgctaatttacatttaatattaataagttaatgatggatattataattggtaggataataccaagagaacaaaaaaagaatacttaactaaaaagataaaataataatgaatagaataataaaacatacttgaagaccactggttccagcaacaatggaataactagtatcagactcatccttccactataaactactattacagctataaaagaaatatttaaaaaaatgttttcagtaaaaggatagcaaacatgaggctataaaaatttttaaatttgtatacatttaagaagcacatgtgcagtttggttacacagatatattgtgtagtgataaagtctgggcttttagtacatccatcacccaaatagtgtacatggtactgttgagtaatttctcatccctcattccccttctactcgctcacctttcagagtctccaaagtctatcattccacactcagtgtttatgtctgcacatgatttacttcccacttataagtgagaatatgtggtatttgactttaagcttttgagttatttcacttaacttaatgacctccagttccatccatgttgcttcaaaagatgtgatttctttctcatttatggtctatatatatagtctgtatatggtctatatatatatatatatatatataaacattttatttatctaataatctgttgatggacacttaagtgttctctatctttgttattgtgaacactgcagcaagaaacacataagtgcaggttttctttttacataatggtttcttttccactgggtagatacacagtagtgggactgctgtatggaatggcagttatatttttagttttttgagaactctctataccgttttacacagaggttgtactaatttacattcctgcaatatataagagttcccctttctctgcattctcaccaatatttgttattcttttactttagtaatacccattctgactggaataaaataaatctcattgtggttttaattttcatttccctgatgattagtgatgttgagcatttttttcatatgtctgttggacatttatatgtcttcttctaaaaacgtctattcatgtcctttgcctactttctaatgggattattttttcttgagttctttgtaaattctggatattaattccctgtcagatgaactgtttgcaaatattttctctcattcttccagttgtctgttttctttggctgtgcagaagctttttcatttaattaaatttcttttgctgtgcagaagctttttagtttaattaaattcgatttgcctatttttgtttttgttgcttgtgcttttgaggtcttgttaatgcattattggcctagaccaatatctgtaagttttctttaggtgttcttctagtatttttagagttgagggtctcatatttaagtatttaatcaatgagttcttttttattattatactttaagttttagggtacatgtgcacaatgtgcaggttagttacatatgtatacatgtgccatgctggtgtactgcacccattaactcgtcatttagcattaggtatatctcctaatgctatccctcccccctccccccaccccacaacagtccccggagtgtgatgttccccttcctgtgtccatgtgttctcattgttcaattcccacctatgagtgagaatacgtggtgtttggttttttgttcttgcgatagtttactgagaatgatgatttccaatttcatccatgtccctataaaggacatgaactcatcattttttatggctgcatagtattccatggtgtatatgtgccacattttcttaatccagtctatcatttttggacatttgggttgggaaaagaccaaatctacgtctgattggtgtacctgaaagtgaggggagaatggaaccaagttggaaaacactctgcaggatattatccaggagaacttctccaatctagcaaggcaggccaacattcagattcaggaaataaagagaatgccacaaagatactcctcgagaagagcaactccaagacacataattgtcagttcaccaaagttgaaatgaaggaaaaaaatgttaagggcagccagagagaaaggtcgggttactcacaaagggaagcccatcagactaacagcggatctctcagcagaaactctacaaaccagaagagagtgggggccaatattcaacattcttaaagaaaagaattttgaacccagaatttcatatccagccaaactaagcttcataagtgaaggagaaataaaatcctttacagacaagcaaatgctgagagattttgtcaccaccatgcctgccctaaaagagctcctgaaggaagcactaaacatggaaaggaacaagcggtaccagccactgcaaaatcatgtgaaattgtaaagaccatcaagactaggaggaaactgcatcaactaacgagcaaaataaccagctagcatcataatgacaggatcaaattcacacataacaatattaactttaaatgtaaatggactaaatgctccaattaaaagacacagactggcaaattggataaagactcaagacccatcagtgtgctgtattcaggaaacccatctcacatgcagagacacacataggctcaaaataaaaggatggaggaagacctaccaagcaaatggaaaacaaaaaaaaggcaggggttgcaaacctagtatcagataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacatacaaagagacttagactcccacacaataataatgggagactttaccacccccctgtcaaagttagacagatcaacaaggcagaaagttaacaaggatacccaggaatggaactcagctctgcaccaagcagacctaatagacatctacagaactctccaccccaaatcaacagaatatacatttttttcagcaccacaccacacctattccaaaattgaccacatacttggaagtaaagcactcctcagcaaatgtaaaagatcagaaattgtaacaaactgtctctcagaccacagtgcaatcaaactagaactcaggattaagaaactcactcaaaaccgctcaactacatggaaactgaacaacttgctcctgaatgactactggctacataacgaaatgaaggcagaaataaagatgttctttgaaaccaacaaaaacaaagacacaacataccagaatctctgggacacattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggctttttgaaaggatcaacaaaattgatagactgctagcaagactaataaagaagaaagagagaagaatcaaatagatgcaataaaaaatgataaaggggatatcaccacctatcccacagaaatgcaaactaccatcagagaatactacaaacacctctacgcaaatatactagaaaatctagaagaaatggacaaataattctttaatttccatcttgatttcattgttgacctaatgaaattgagaagcaagttatttaattttcatgtatttgcatgattttgaaggctccttttggagatgatttccaattttatttcactgtggtctgagataatacttgatataatttcaatcttctaaaatttattgagacttgttttatggcctaccatatggtctatcttggagaaacttccatgcactgatgaatgtaatgtatattctgtggttgttgagtagaatttctgtaaatatctgttaactccgtttgttctagggtatagtttaaatccattgtttctttgttgattttctgtctcgataacctgtctggtgctgtcagtggaatactgaagcgcttcactattattgtgttgctgtctttctcatttcttatctctagtagtaattgttttataaatttggcaactccagtgttaggtgcatatatatttatgattgtgatattttcctattggacaaggccttttatcattatataatgtccctctgttttcttaaacttctgttgctttaaagtttgttttgtctgatataatagctactcctgcttacttttggtgtccatttgcatggaatgtctttttccaccctgttaccttaagtttatgtgagtccttatggttaggtgagtctcttgaaggcagcagatatttcattggtgaattcttacccattctgcaaatctgtatctttttagtggagcatttaggccatttacattcaatgttagtattgagatgtgaggtactattccattcataatactctttgttgcctgaataccttgggtttttaacatttatttatttattgtatttttttataggtcctgtgggattcatgctttaaaaaggttcagttttgatatgtttccaggatttgtttcaagatttagagtatcttttagcagttcttgtagtgctggctttgtagtgatgaattttctcagcatttgtttgtctgaaaaagactgtatcttaccttcatttatgaagcttagattcggtggatacaaaactcttggctgataattgttttgtttaaggaggctaaagatagggtcccaatcccttctagcttgtacagtttctgctgagaaatctgctgttaatctgataggtttttctttacaggttacctggtacttttgcctcacagctcttaagattctttcctttgtcttgacttaggtagcctgatgactatgtgcctaggcgatgatcattttgtgatgaatttcccagatgttctttgagctctttgtatttggatgtctagatctctagcaaggccagggaagttttcctcaattattccctccaatatattttccaaacttttagatttctcttctttctcagtaacaccaattattcttaggtttgattgtttaacataatcccaaactccttggaggcttttttcatttttaaaattcttgtttctttgtctttgttggattgggttaatttgaaaacctcgtctttgagctctgaatttctttcttatgtttgttcgattctgttgctatttccttcatttcccaaagttgtgattgttttctatttatgctgtctatttcactgaagatttctcttctcatatcttgtatcttttttttttaatttccttaagatagactttttttatttccttaagttgaacttcacctttctctggtgcttcatcaattagcttaataattgactttctgaatcctttttctggcaattcagagatttcttcttgtttggatcctttgctggtgagctagtttgatttttttaggggtgttaaagaacctcattttgtcatattatcagaattgtttttctggttccttctcatttgggtagactacgtcagagggaagatgtggggcccaaggcttctgttcattgtcttttgttcaacaaggtgctcccttgatgtagtactctccctattttcctagggatgtggtttcctgagagctgaactgtagggattgttacttctcttctgaatctaactacccagcagggctactaggctcaaggctagtactgggggctgtctgcagagagccctgtgatgtgaaccatcttcagatctctcacctcccctactctgctagaggtggcaggggagtgaaatggactctgtgagggtccttaattgtagctgtttaaggtactagttttgtgctagttggcctcctgccaggaggtggcactttcaagagagcatcagctatggtagtatggggaggaacaggcaatgggtggggccctagaactcccaagggaatataacctttgtcttcagctaccagggtgggtagacaaagaccatcaggtaagggcagggttaagtgcatctgagctcaagactctccttggcgagtcttgctgcagcttctgtgggggatgcgggtgtggttcccaggtcaatggagttatattcccaggaggattatggctggctctgctgagtcatggaggttgtcaagtaggtgggggaaagttggcagttacaggcctcccccagctcccacacaatccaaaagcccggtttcatgcccactgtaccctccaaacagcaccaagtttgtttccaggcagtaggtaagcaggactgagaatttgccccaggctaccagtctcccagctgagaaagcaagcagagctttcctgcctccttgcctgtggactctgcacaccagattcatgccctcccctgagttctggccagaacactttgcattcagttggaattgttacgaagttcagctggtggtttccttctccctgtggtcttttcccagttcctctggcagcccctccccaaggacctctatgagacagtcagaagtggcttccctggggacccagagagcccacagggctttacctgcagctttttctacccttgtattttttttatatatttatttatttatttttaattttattattattatactttaagttttagggtacatgtgcacaacgtgcaggtttgttacatatgtatacatgtgccatgttggtgcgctgcacccattaactcatcatttagctttaggtatatctcctaatgctatccctcccccctccccctgccccacaacagtccctggtgtgtgatgttccccttcctgtgtccatgtgtttttattgttcaattcccacctatgagtgagaacaggcggtgtttggttttttgtccttgcgatagtttgctgagaatgatcgtttccagtttcatccatgtccctacaaaggacatgaactcatcattttttatggctgcatagtattccatggtgtatatgtgccacattttcttaatccaatctattgttgctagacatttaggttgttgctcggctctctaaattatctcagctccaggtaagataaaatccttctcctgtgatctgactttcaggttccccagtgagagtgtgtgttcagagatggacaatcaccctttcccagtttcactgtttggacactcacagtatttaggctgtctcctgggtcctccaggagcaaaccactcctccaaagcgtctgtagattctctcagctgtcctagtatattcctggcaggtagttcttagagaaagtgttcacaatgtgagactccacatgctcctctttctgtccaagtgggagtgtaatttattcctgcctcctatccctatttttttttttttttttgagatggagtcttgctctatctgcccaggctggagtgcagtggcaccatctcagctcactgcaacctctacctccatagctcaagcgcttctcctgcctcagcctcctgagtagctgggattacaagtttgtgccaccatgcttggctaatttttgtgttttcagtatagacagtgtttcaccatgttggccaggctgatctcaaactcctgacctcaagtgatccacccacctcagcctcccaacatgctgagattacaggggtgagccaccgtacctggtatggagctagttttaagtatgtttaatcaaccaatgacaactcacttcagtaaatatggttttatgaagtaaccaaatatggttctgtgaagtaaccaaacagcaaaagcccttcacatctgaaagtcagccaatcaggtaaagacccaatgaccacgcatctgagtgccaggcaatcaacaacagtcatatacaaataaccacataactacagtgatgttaaattactccatgttctctgaaaatctgctagtcattgaacttcatcattttccaaaactctatagaagattagcattcttctctgcttagagacactgtgcctggcttatacctccatcaaactctgtggcccctcttacattcatatcaggagctcctaagccaccgatatgatgtcagtgggatccacagaacccaatttgaaaacatatggtgtatacattatgacagtgcactgaaaaagattgtttaagattctacaagtaatcatattttgtcaagtttggtgaggtttaaaaagcataaactaaaatatcagacagcagtggcatataagttggggaaggggtcaaaattcagcaacctaaatcttagattatttaagttggagatattaatttcttaaatttgtctgcatgttaaaaaaaattcaaaggcaatcattaagtaaacgacataaaatgtgtaacttccattccagaaaaagagaaacaaagcaacaaaataatctggataatccaatacgaggaaggaaaggaaaaaaaaaaaaagaagcaaagaaatgtattatcagtgatgttctagagccagcttatagtctttcagcagctttcaagagctgctatgcacatctcttttcatcttttcaaatctacttcagttacttcatgtcggttgcttgaattctgccatcttgacagtatttacatcaaggaaataatcaaatgctacaaattaataatcaaatgcttttgtttcagagagcctgtgttttgtatttgtttagaagatatccacataaaaatagtagagttgaaaaaatatgaacttgatgttgagaactagtgacactgagcagagacaattcttataaggaggtagcttcaattgcgtagttgttacagagtggcatagggccaaggagaagttgttttataataaggggaaaagcctgagcatgtttacatgtagaagagagggacctagcagaaaaataaagcacacttatgatactgaagaaagagaacagaattgataaacagggccttgatgcattgactgaattaagaacacaaatgagaagaaaagaacagaacacaactgttatgtaatgggaggagaggttgaatgcagaaggttggtgtttctagcaaatatgggtataaggcaaagtccaatgtaaaactccccatatttagtacaaccacatcctcacatttctgcttccaacaaaatttgggctagccaagcaacagcagcttttaagatgagatagaataaaggtcttgaaagaacagagtgtggatactttactgccataggaaaccacagatgttatcttgatgtccaaggcagctgcagaactaacagcatgggcaaaaattgcatcccctgggaacctacctttactgtttctccctttatcatattctcattttttttctctctctcttgttcccaaccctctcctatggaacactctgcatcaattttcacgtgaggatcacatctgcactgaagtcactaggacaggcagaggttgctgcagttgcattgatggctctcgtccttaatgacactttttttttctcatcaagatggaggcataatgatcttgaagcagcaaagggatcaattaagatcctgatcccacttcccatccttctattcaggctggggtgatgggatttagaggaagcattgagcataggagagatccagattttattagagaaaataaatggaggtcatattcagagaatggttgaggattagaggtgtcaaagaactcagctgaaatattcaagagagaggagaaaacaattatttgagggaaaaaggaagcacattaccagagtaaagcaggaattagtggaagggagaaaagactccagagactttttttcttggatactaatcaaaggaggatagatgtgagatactgcatttttctctcactactaaatgataagatagcggaagaagggatttggtatgtattgctaggttctcgagatagcactgggaaaactgaaaacattctctaagaactcctaaagaatgtggtccctagtctagagttgtgatctccttttcacatgattaaagtttttgcttgcattctactgttagagtgattttccccataatacaagtatttgacacactggggaggctgttagaaataatttaatgtaacagcttaatgtccttcttgatttctgaaagatatgtgaatataattatggaatatttttcttgatccaaacaggaaatgaccaaatagattggggtgacaccacttaaagaggaaaatcttgcaattattctcctttattgaggcaaaagccgttacccacccatctccttttcaaggaaaatgttgcctaggatttgggactccagatactagaagagttaggaagggtatccaatcactatggccttcactgtttgactgtaaaatgaggatgttgggctggatgatctcaaaataccttgtcacctctagaatcacagtgattctctgtgaccatgtgcccctgtataatgagggcaatcatcctaaaccttcttaagagagaagttattcttggcgtgaacccgggaggtggagcttgcagtgagccaagattgcgccactgcactccagcctgggctacagagtgagactccgtctcaataaaaacaaacaaacaaaaaagaaagaagttattcttaagagagatgactcataaactaactgcttcctcacaaaacagctgctggctagacattagaaaaaaactttaagttaattcatagaactttagagctagaatagaccagtactagcctgcaacctgcctcttacaggtgagaatatagtcccagattgagttaatgacttgcttaaaggaacacactgattagtagtgcaatttagctttttgctcatgggctatagcatttaaaacttgcctctgatatacatattcggtgagctaaactgaactgctttttaaaaagcttgtacactttttatataatttctatttcatagagatttaaatagaaaacaagatttttaataaggagatttaaagaggcttcatcacagcagcagtacataacattcaatctcctacagtaggtttttaccagtttatttctcatcacacacaggagttcattagcttgggtgagaaaatgacttctatattcaattaaagctcactgtccatctcattttaaatgggattgtaatagaaaatattgtaccaggtaaaacttcaggccaattctgtgcagattgcagtcaaattgagtatgtttgaggggccataaaatttataattaagcttatgaaatatagatggtttctgatagggatgcttcacaacaattgattgctttataagccataataatttggaataggaaatagaataacctcataattaagtattgcttcttttcaacctgaaagtagtgattaaaggactactctgattttataattctctgaaatatttagatttgtaggcaatggtgaaatgctttttgatgcatcttctgaaatataaagtgtacaaagcaaagtgtaatcacatccaagaagaacaagctgcatcttttcttttagaatattttgtgtttgtctccagtagcattttaattttattttagtctcgtggactgctctagctgggacactgtttgcaatgtaaggaatttaagattttaattttgttcatgacaaaaaaatggcatttaactgatggcctttgataatcagagtagaaaagagtggccatactgaaaaataaatcactaatcacttcatttaggaaaacactcctgaagcaaagctatagcaaggtagaaagtgaatataaatcaataaaatattatgtgaagtttagcttttagggaagagaaaataggtaactttcactgtctatggtatagattttacagtaaacaataatagcacatctaaggaggcaccacttacgttcaggtacgtatatgtacattgtacacattgtaagtgtgtacatttattgcaattttcctaatatatatttttgaaaaggaacactagttgtaatccaatttttttttttacagtttgaaagttccaaaccatttttacaatcaacttcaatctctgtgtatagggtgagagggggtatgcatatgtgtctgtgtgtcagtgtttcttttagccttatgttacctattacctcaacacaatttttaaaataagaacgttaaatactatagaagttaagcgagttaatctatcattaactgggataccacagcaaacatcaaccccaatcatattttaaataaaacttcaaaacaactccttgaaacaagcactgtagagttaatgaaatgaaaatctatacatataaactgcagaaaacaacattttgcattattattttaacgtttaaaatatagaaactatagtatattattttcattcagagaactgttcatgggttaacacaatttttcaaagaagaaaaataaaagtgaatctgaactctgtcatttagaccaaaaatgttttaaagaaatgtcttattgaagtccacagtgagttctagaagtagaactcatttgtagctaatattaaaaattctatttgaaaatattactttgccttagtattagaaagatctctaagattcactttatatagttttacaatttaatgaaacctaatgctgtattagagagagtggaaacgcgaagatatcctctgttgtattctattttgtctttaaagttatcagtattgtatcacacgaatcaaagttaaattggatctctaataggcattttctcttgctaacaaaagcaactgcttagtgtttccatttaaatgtgaaataaatcaataatgtgatataggcaaggaagaagaacatgctcacaaagacaacagatttctaaataatgaaaatacagtcttgggagtcacatgcaccaatatctgtgatgccaggagatgtatcaatgatcatactcttgaagattgtgatcctgtcaccatgtttactaccggatctacatctgagattgctggctctagaggtaccatgtgtgtgtggattcagagatgtattcatcccttatcattactcatttaatatttaagcaaactattctacctctctgggtcctctatgagaattggaaataaaaacaaaagtcacacaaaagatttttccaaagtgtgttatacagaatgtaacttcttatgatgtaagtaaagaataagtaaaaaataaatcctgtattgaggtatgataaagaaatattaaacaagtttcatttttcctttccattctaaagcacatttaaaaattctaagagcacaatatactgtgtggcatttctcaagtacacttgcatgtggaacttttaacagagtccttactgaatcagcatttgggaaatgctattgtaaataatggctcttacaaattgtagaagagcaaagcatctggaattaagaacccttttttctcacaccaaatgtattagtgcaataaacatttgatttgtagttagtaatacaagtcttaaaacacagaagttagaagacttactttaagtcagattatctctgaggaatccagaggcatagcaagtggttgaatttattattctagaattatattgtgcccaaagcccaattgtcttggggttacgattattacttgatttattagacctaagtaatattggaatgcaaatatcctggagaaatatcctagagatatgtccaaactctaaaggaatcagctgattatgtaatataacattatactaaagcctaattcaggatgttaaaacatatatagtatgattatcaacccatagagagcaaaagttgttaatgcagtctacccatatagaaataagggtccccaaggggcaacttctggccctgatggcatgaagaggttagcaaatcctctgccccttcaataaaacataaaactatagaaaattatccacataatttcaaggatctaggaattgatcaaggcaagtaacaactcatgaagtatttatataggaaaacttcatagaattctatgtaagaacagtagaagtctgttaactttattgatgggagctacttccactatctagaagacaccacattctagaccacagaacaaattcccataaaattaaaaggattgaaataatacaaagtgtgttctccaaccataataaaattaatctggaaatcaaaaatagaaataaaaaggaaatctgcaaaaaagtggaaattaaacaatgtacttctaaataaccgtaagttaaataagaaatcaaaaagaaaattgaagatattttgaagagaatgaaaataaaaactgaatataaaactatgggagactgaaaaaccacatttataggggcatttaaaattttaaacatttatattaggaagaaaaaatatttaaaatcaattattgaagtttttacctcaaaaaaagggaaaataaaatgtaaaaacatgaaataaataaaagataattttaagttacttaaaaatttttttcttaaactcctttcattcatttcttcttgtattcttaattttatagctctttacagtaagtaggaaattttgttactagccattccatcattaccttatacatgcctctttatgaatcactctttctaccaagttgacaatgatacaaacaggaggtagggaaatactgggtagaagagtgccattccctggcaaagattccaccctcaagcctggaaacacacagccctaaatgagaacaggcattcctattttcgcactcaaatgtttccttttccaacaccactctgacctaccatgccccatcctgtgcccatataaatcccaagcttcaatagcagagcagcacagcagcacagcagaggaggagagaagagaagaagtgtctgaacgtcaagaggagttcagctgaggacagtcggagtggaagttggctgtgggatagccaaactcaaggagaagatcatcttcccactctatcccctctccaccttcccatctcactgagagccgcctccatcactcaataaaatccccggactcaccatccttcaactccatgtgacctaattcttcctggacgccagacaagaattcaggatgcactcagtgtgggaatccaaaaaggctgtcacactgacttttcactgagtggtttaacatttaagctgtccctggacagcagggctaaaagaacactgtaatacccctagacattgccatggggctggagcccaaaagcactcaccccagctcctgcacctgctcacttgcatgctccccctcccataaggggtttgggtgcatggcagccaagtaaacaagccacacttctgtcacaagtcccatgaggggatcagggaactctcccatttcaataatagattggattgaatctactgaatacagtgagataaataaagctatgttgcaattgtttaggccaggcatagtgatggctttgtctagcctgatggtgatagtgcaggagaaaaatagataattgtgaaaaacatagggaatactattgatatgatttggtattcagtagcatgacaataaaaggcaaagggtgttacagaatgacaggtttctggcttagcctacaagatggatagtcatagtaaatttgagagtcctgtgagttttccaagtggaaatcatgacaaatagggcacatttacaacgataataacacagacagctccttgaactttagctgtaaatattctattttcagtctactttggtttttcattctgcattctgtgagctctgtaaggatgtaccataaataagaccacgtctaatttttctttttctttacaatacctgacatagatggagcatgtctgaactaaggcaacagaagtaggaatggtagattagggaaagaggagagattaaagaggcagagtcaactgaagttagtaattgatcatatgcagacaattaggacaaaggaaggagactaaagtgattccccagtttaaggcatgggcatcttgaaaaatggtgggacagttggttaaaatatagattatatgagcagaagcagtcttgaaaaatgtactgagtgttgttttgataagttgagtatgtggttatgttcaggtgaaggtgaaaagtaagaagtcagaagtactggcctgaagtttgtaaagtaaatccgagctacagatacagtattggaagccagtgtgtatggtggtccacaggtgtggataatataaattaagtcttgggtttaaaccaaaaagaagagttctaaatggaaccttgaggaaccattatttaaggtaataggtgtggaaaagaccgtgagctcagtgaaaagcattgaataagtttaggaatgagtaaccagagatgaagaaaaaaaaaaaaagcagacagcggtgctatgtttcattgttttttaattttataattggtaatttccacttttattccttatttgctgctgtgaaatgtcacacaattatttaggattctgaaaatagtggaattttctacttctacttaatttttctcatatcctttttgaattatatgctcatgaatgtttttacattgtaaataagtcagtaaatacacacacatatacatagatggggaagtgagagtgcttataaaagaaacccaaaagtttctttctgatagggtatatttcgaagaaagtttgagaagtactagtctatgcctattacaataacctcctaagcctgcttgtaaaattacacctccagctaaactatctttcacagtattactggagaagactttttgaatgtctaatcatgatagttttctgtacagttatttctgatgaatcactaaagtttaaaactcaatgtccttttcattgtaacccaccctaaatcccacaattagctccagttgtattttttggcgctctcttcccaggggtcgagtgctttctctgtttctgttttctctattttctgaacataccctgatgcccttaaaaatttgctgttcctttagtgtcctctactaaaaatttcctaataaatatagccttcccacatcccaataggcagaactgagggttttttcccaccatacaattcccaccatacaaaggacatttaactgtaaacattcaccactgtgcccatgcacatcccatgtgtgtatttgtgtttatgtctgtctctctttctaactgtaatcccagagaaggaaggaactattttcttttttttaaatttcccatacatcttaatggcaatttacctacttgggtttttaaaaaaaggatttttgagttattttgaattgaatcaaaagtatgatcaataacttattcttagtaacaaagaataagaaacatatcttgttagttacttgtttctaaaataataacctgtatgcattagccgtggatttatattgctatttacagctctcccaatgcttctagctttagatatgagatcacatctgaaaagatctcatggacacttgggaacattttcctggaaaatctttgcaataactttattatttgaaaacagtaatattttttaaagtgtcaatttttattttattttaagccagatgtaaagccctcagggaaataactgagtcatattttgtcacttgtgaggttcaaaggacatctctggaaattgacatacaaatatatcattattatcatagttgcctctaaatactgtgttacatttaaatgtaaatgagttcttatgttatttacaactaaaatttcactaaattttccattagcctagttttgtcttttttagagtttcacaccacaagtatgagaactccctcaatgaagaaccatagtaagggagtaaagaggtgtgactctccatcagttttattgacaatatattccctaagattagaggtcttcagagttgttcaggcagcaaataaaatactagttaaacaaatgttattgataccatccttacaaaacaatgaaaagaattattcgtttgtctgaagaattagatgaataggttccattgaaattttatatgttcagaggaatatatgtgcctattttcatagtaataaatagcacaatttccccaagaaaatgtgggattttaataaattgtgcttctggtttacttctcagtggggctgtggtggcttcaggttcatgacaaatccaattatttggttgttgaactaccccttctggaaagcaaaaataaaaaataaaaatccatgagagaaaagaaaataatatgaaataatatattgaatgcctcaggcttgctgctagaaaatgtgcgtgtattttcttattaagtgctcacaaagctatctgttgtcaaaatgcgtaacttaggaaggggcttcaggatgactgaatagagaggcgtcttgtatacatcctacacaaaagaactcatcctacacaaagaacacaacagggattgacagtgagcctggagtggctcttcaatataagcaaagggtaagtgagacacacccaccagtccacatttccattctggatcctaaaatcctagccatgggacaacccctcgaccctcaaatgccttcagactcacatagagagatgcctggggaccacacaatggcattgctacagagaggggtctcacactgtgttccacacacctctgagtcctaggaagctatatacccaattttgacagctcagcccccatgagattacagtcttctctggggcccaaaagctccggcatttccacatccctggagcctctttgacatcccttgcccacagccactatcttggatggctgctgctgccagggttatagaatgagtcattggcagtgatccagcaatttccagcagcaaaactgctgctcatttacatcatctgaggcctttccctatgaaagcgaattttaaaaattggaagaagcaactgttacacctgatgcacacatgtcaacataaggacataagaaacatgaagagtaagaaaatgtgacaccttaaaaggaacacaatacttctttgacaacaaattctaatcagaaagaaatttataaaatccctgaaaaaatcattcaaaataaggataattaagaagctcaatgagataaaagagaaaacagacaatatagaacaaatcagaaaaaaataattcaggaaatgaattagaaatttaccaaagatacagatcttaaaaaaaaaaaaaaaaaaagaaagaaacaagcgcaaattctggaactgaaaaattcattgaatgaaatacaaaatacaatttaaagcttcaacaatagactaggtcatgcagaagaaaaaaacagaacttaaagacagaccttttgaaataactcagacaaaaataaattgtaaaaagtgaacaaagcctatgtgacatacggaatacaataaagcaacaaaatattcaaatttttggtatcccagaagataaagctataaattaaagtggcagagaccatataatggaataacagctgaaaacttctcaagtctagcaagattttagacatccagatgtaggcagctcagaaattgccaaatagatacagttttaaaataccttctcaatggcatatgccagtcaaactttcaaaattcaaagacaaaaagagaaaaacagcaagagaaaagtctgtagtcatttataagggaagccccatcagactatcagtgaattcttcagcagaaattcaggtaattcagaaaaaatgagatgatacattcaaagtgctgaaagaaaaaaaatgactacaaacaaaggatattatactcaacaaatctatccttcaaaaggcaaaataaagtctttctcaggcaagcaaaaactaagggaattcatgttttgaattgtaatatactcttgatgaattcatccctttagcattatatagtctttttttctaaattgtctttttttctaaacactatattgtctttttttctaaaataaataaacacactatattgtctttttttctaaaatttgttgtaggactagattggtcttacaagaaatgctgaagggagtcctgcatctgaaaacaaaatgataaaatttaccatgatagaaacacgaaaatataaaatccgctggtaaagcaaacacaaataaggaaaagaaaggacccaaaaattatcactacaaaaaaccaacaaaccatgatgagaagcagtaagaaaaaatggaacatgagggacttttttgtttgttttcttctatttgctaaggttttcctctaaccgtattctgccaccaatgccattttccaaataccaccacaatccttattaatcagacacactctcctttgaatttaatttaacaatttatgctttttgtacattcgcttggagccttatacttcatcttaggcaagtaatttcctacaagtcagtccagtgttctcaatcctgtgtcatattagagagttcttacatataaaaatatttcataaaaaaattagatttgacatcagtgaaaagtggatgaaaaatagtttattctgttttatgggtgcatatgttgctatccacatctaggtgtgcatgaaatatttatctggtgtttcctagaccatcagaatcaagaaagagttttgagagttgtttgagctccaataatagcaacagaatttgtagattcttatccaatgctccaaactaatggttttactgcaagaagccagcctttatttaatctttggagcacagtgataataacactggttctggaggcaggttctgttatgtatagctctatacttttggaaagggcatttaagacagttttcctcattaaaaaaagcatcagtgataataatattatttatctttgatgcctttttttgggatggagtctcattctattgcccagactgactggagtgcagtggcacaatcttggctcactgcagcctctgcctcccgggttcaagtgattctcctgcctcaaccacctgagtagctgggactacaggcatgtgccacctcgcctggctaatttttgtatttttagtagggacaggatttcaccatgttgtccaggctggtctcgaactcctgacctcaggtgatccgcccacctcagcttcccaaagtgctgacattacaggcgtgagccaccatgcccagcttctttgatgcttttaaatgcatgtataaagtgctttgcatgtgttatgatgttaaccattatgtctagtgggtttctttaactcttgtttttgcattgcaggtaaacatctgtactctctgtctgtctgtctctctctctctctctctctctctctgcctccctctgtagagacagagagtacataagtatatatagactatatagacagattatatatatagagagagtgtacatacagagaatacatacatatatacatatatatgtatatatgtataaagtgctttgcatgtattataatgttaaccattatttccagtggatttctttaactcttctttttgcactacaggtaaatgtctgtactctctgactctgtctctctgtctctttctctctctgtaaagacagagagtacataaatatatgactctatatagagagtatatatatatatatatatagagagagagagagagaggaactacagagaatacatacatatatagagatgattagataatactctatattagataatagactattagatatgactaataagattaaaacctctaatattagtgcaaatttagtacaaatgtccataatttcttctagtaatcaattacttggcttttttgtctctcagtagctttatacttatataaataatacaaatttttactatttatttttctacacattaatagattcatttttatatgtactcctttataattcacattattgtctaatttttgaatgaatgtcattgtatcttatctgacaggcatacaaatgtaaattttgagggtatatgataatatttattttatgaatactggtgatgatgatgggcatgatagtgacaattatgatgcaacggtgatgatgatgtaaaaagtaatgatgatagggatagaagaaattggagttgcaatgctagttaatattaattttttcatatgttgagttccagaaaataaaatcaagtgcttttataaattagcttaatcttctcagaaattccatgcagtaactaagatttattttttaaaatttagctttagagatattaagaaatatgcccaaaataacttatagcaggcagagctttgattctaattgagactgcctgactccagagccaagtaggctaatgacagcatgtttagttttcattttttttttcaaatgtcaagaaacatgtttaattaaattgagtcaataaagcagaattccctgtagaattctctcatgccaaattgggctcaggccattggtttgaacatgttttaaaatcacctagaataatatcgaggtatatttttgtgaaacatcttgttttgttataaagaacctcttctttaaatgcatgaaataatgactatacattattgttagactttttcttccatttaatttactataatatcccattacctcagctttcacttttcttgctgaacatacatacagcatactttggttaataataagcataattttaaaatagaatttcagaatacttgttgtaaaaggtgacagggactgaaagaagaacaagcatcaacaggaataaaatttaaaacatattttttggaaatgaaattttaggaatgattgataagtgtttctttaatttctcaaagccctagtttcctcatttgtaaaatgattataataatatatgtctcatttaataattgtgagggcaaaagttacataattgttgttaagggctgaattgtcttgccctaaacttcatatgttgaagtggtaacccctagtacctgagaatgtgtctgacattctggacaattaactttaaagagttagttaagttaacattaagctatttgtatggttctaaaacaatcgatttgtccttatttttgaaagagaattttgatataaaaggggacaacagagacacacgggagcagtgagataagcgtgcgaagagtaaccaagtgagcagccatctgcaagccaaagagaaaggcctggagcagagcatcccatttttgtcctgctgacatcctgatcttggacttccagactccagaactgtgagaaaataaatgtctgcggtttaagctacaaatctatgatattttgttatgttagccttatcatatgaatatgatagtatgtaagtatatactatagacaccacgtgtgtctaattatgttcttctgtcagccattagtgtgacaggttaagtccacccaatactttgtggagttgcttttggaaattgttactacagcttccttcagaccatcacaaatttccaggatcctccagaaatagaatgctgtaacgttgtgcttaatgttacttctagtttgcccaagaatttttctcagcattcctgctccaccagttttcagcaggacctctgtgcccaaatcacagaaggttctctctgcaatcttgctcctcctcattggcagttcactgttatattttatatgtgaaaaaatcatgatagaaaccgttggtagttcccggttctcccggtctggacttattctaaatcagaccctgttcaccaggccctgtgtacctggctcttctccctaattcaaccaaactctttattgcgtgtgtggagggtctcagaagagagaacattttctatccttccctcagtcatagcagtattggttggtatcagtacagcattctgggtccaagcttctctctcaggggcagatagattttcctgctctctaggtggcaatatacctttgcatgggaccaggatcagaaggatttgttggtcttcccacaaaagtagactacactgagcatacagctcgtgggattttctttccctctcttttttccttccccagcaacagatgacttgcttcgaccccttcccctctgaacaatggatctttgcctgccttctattcccaagttgcttgaggcttttaattcatataataaaagagctcaagacataggcaaggttttgtgcccacactctttttccttccctgcctctaatcttcctcatgagtatatagtggaggcttatgaaaagtacatggcaaatgaatgcacactttcactgggtctggagttctcaaaggttctaaatcgtcatgctagcccacaatcaacttctaataaagtactgaaatgtaattgtttcctctttcctgcttgtacagtgtttttgtcccatgttttgccaaaggtgaaacattcgtctgttctctctctcctcagaatggcctgccattctggaatttagtccacctgattgccttgagatctgagctctgatatgtcaaaaaatgtgataattttgaagattatctggccttttcttcttgccaattaaggtgggagtgatattctcttgtaggacatcataaatagaagcacaactctctactgacaatcctttgagaagactccaaatatgaatacctgaatatgctgagactgtagaatgcaagagtataaaaaagcaaaaatgtactttttatcagtaaatccaataaatatatttcataagaatgatatcttccacttacaatgtatgtatatattatctaagtatccctagtgattatatgtagaggtcatttaaaagttaagaatgctcaaagaggttttggaactaattatatttcatctagaattatgtatttcacagttatacttcaaaataaaatcatcatggtagaaattgagtgattttgcattatgaggagacatcagacaatcaagacttgtttgtttgttttcgtttttgaggtggagtctcagtctttttttattgttgttgttgttgttgttgctgttgtttgagatggagctcaggctggagtgcagtggcacgattttggcttactgcagcacctgcctcctaggttccagccgttcttctgcctcagcctccgattagctgcgattataggcatgcaccaccatgcccagctaatttttgtatttttagtagagatggggtttcaccatgttggccagactggtcttgaactcctgacctcaggtgatccacccaccttggcctcccaaagtgctgggattacaggtgtgagccaccatgcccagccaagacttgtctttttgaagtaagaataatttacctaacccccagagtatctccaatacattctgaaatttatcagatagccagccacaagagagatacaacattatatatccaaaattaaaaataaaaagtaggataaacttcattattagacaattagaagtatatgcccagaacatacatttgtaaaactacgctataaaagtaatagaattcaacaggctgaatgttagatctataaacctagggtatccattcactagagaatgaaacaataagaatagtaatcaatgcctcaagagaaagctcaatatttctaacagaagaaatcctgcatatataacaaagggttactagtggcttgagaaactccaggaagcctatatagagaatgttttatcaacctccccactgcgaatgttcctgtggaagaggaagcacaggaaagtactgcatcttttaaaatcttgaagcagggactgaatatttactctcagggggtggtacacttgcaataagtattttgttatattaccaaaagaaaacaatctgaggtacaaatggtaagaaaatgttagattattcagaaagctctaaattctggaattttttgttaaagcttctgaatatctgcacatctactaatataattttagtaatatgtgtgtaattacaaacctgcaaatttgttgatattaccatgccaataaatgtttccaactcagcatttcttaaaatatggataggagaatagaaaatttatattcctccaacttctttaccactttatgaattttagtaagatagaaagcagcctaccctgaacacattttaggaaaacccagcttttcttctgtattctgacaagggaaaaacctacgaaagtaaaaaaggctaccgtctctcttgctcgaggataccacttacatttagttcaatcacaagaacagataataaagggtaaattgcaataggcaatttgccactttcctatgattaacaatcattacattgctcattgctgtgccactgtgtctgtgtatataattgtgtaaatgtttttttctgcttatccatggaatatatctagacaatttgaaatctactacctgcttgttcactactcctattgcagctaatctcttgaatgttaaatttaacctgtctatttaaagtcatgatacttgataataagtactacatttatgaagcacttattacatgctagtcatttggtgtacattatccactttaattattaccacagctttgagatgcatgaaatattatgatctttattttatagattagtaaaatgaggtttacagtgtttgtgtcatgtccaatttcacctagctaagtaatagatagaagaaaaatctgatctgatatgtacctgattactatgtatcttttcctacctcttgcactgtaccgtctcatccctccagcaagaatgacttcaaaagtttacttttgtctatttaacttggataccaataactatttcttgactttgaactacataggaattttttttttttagaggaattttgctcttttgctcatgctggagtgcagtggcacgatctggggtcactgcaacctctgccttccagtttcaagtgattctcctgcctcacctctgagtagctgggactacaggcgcccaccgacatgcccagctaatttttgtatttttagtagagacagggtttcaccatgttggctgggctggtttcgaactcctgaccttgtgatccacctgcctcggcctcccaaagtgccgggattacaggcatgagccaccacgcctggctgcataggactcttaatagtctcggacagtggctcatttctctaactattgcaaaattgagttttacaatccatcactctatatttctcaaccaaacatcttctctttagtaccatcttgtagtcctccaccatcagctgctagttattccatatagctgagtcatttaaaaaaacacagacgagaaactgaaaccacacagtcatattgacacatgatgggcctttttggataaatacaatatggcctcaagtccagattgattccaagcattaattaagtgcttatgacaagaatgtgtttgaaaagaatggattttatttggtacatgtagttttaataactacacttctatatttcaagccctaggcactatagctgcattcctctgagaattttcctcatcagaaacattgtggaattaggtactatatgacatctggtgtaaaatcaaagtatttctgagaaggtaaaatgtgatattattcaactcaacttgaaacattttaaaaatactcctatagccctggaaactttgttcactaggccattgaatgcatgctattttgacgtaatgtcactgaagagacaggagtttgattctacactgaaacgtcaactcaaatttcaatcattgttataaatttgtgcaatttatttgcattttttttctaaatttcaggaagtgctaaaagcaaatggggcaaaattatgtagtaaatccacaagttttgtgctctcctaactgcattgtgcattgtagcaataaaaaatatttaaagagaaaaccaaaagaacaaacaataccctagaaaaagataaactttttaaaaagctgaaaattgaatataaaatacaaagaagctaagacaatgaagttaaagattgccgaatgtcaggtttgggagaacactgtagcagactgaggttcagtttcagaggattaacacggaccaaaagtgttcctatgcctggagtttaatttagattcattgcttaaagaaagaaactaagaacaaatgctgctgatggctacctgtggcaaggactcataggatcgtgtgggctgaagagatgggaaaatataaacacagcctcacagaagaaataaactaagtttgaatctgtaactggctggatccacaatatccacaaagcagaaaagccaaaatgagagacctgattccagatgctgattctactggaacatgttcaaacaagcctctatatagaagatcacatggaaggacggagggagataagagaaaaaagaaaggaaacagagagagagaaagagagggatccttttcaatcaaatgagtctgcaaacacaaatcctgaattgcctgaagaaagatgcacacaaacaaaaatcaacaattagaacattaattcattccatatgaaattgattataaatgtttcataaacatattaaatatatttaagttgctttaaaggataaattaagatttggcattgataaacaatttttaaaaagaaataaaaaaaacagagaaaatgtgtataaaatagtacaggtgcatatgaaaagaacctactagaaatcctggggaaaatatagtcattataataaaaactctgttagaataatggcccccaatgaatcacaaccttcttattttacattcttttatagtatgagtttcccatttcttcacctctttaattcagcatggctttgagatttgcatagactgacagaatatgacaagaatgatattatgtgactttttatgctaggccttaagagaccttgaacttccgccttttctgtcttggaatgaatcttttgtctcgtgaataagcaactctgggctcctatgagatgagaggccacatagaagagaagtaaaaagctacagacaagagccaacaccaaccaccagacatataattgaggttaccctgaaataaacaccccagttaaggttcagataactgaagccatatatgagtaatcctaggcaagatcagcataagaactacttagataagctcaacacaagttaaataaatatatacttgttttcagacactaaatttggaatgatttgttacacagaaattaataattaatacaaacattggcaactagaaacaaggtgctgccataacaaaatcctaaaagctaggcattggctttgggaccatgtagtaggtggtctatagaaattgctatttatgtctgaaaatgtggggatcaaaactattggcaaaacttaagacttaaatagattaaaaaaatgtatgcaatgaatgtgtagatatagccaaggtgatatcccgacagaacaatgaaattgacagttggctttttgtatctgtctataataaataggagaggaggagatgaaccaaagggagtatgattcatttggaaagcagaatttagaggaaatataaaggttcaagatgtgctgggttagaaaataaaatcatttcatatttctagactttctagctgtggtcttagaataaaaatcaaaccaagtgtgtggtgataaaacctttagttaagcacacagagaaatttatgatagtgatcagtaaatccttgcaattaggcaaagaacttctatgagtttcaagggtattatctcacaaacaccttacaaatggcccaatgtaagtagaggtttatttgttaaatagttatggatgtggcttttgaacacggagggaatctcaattagattcacaaaaaattcaaaatatttaaggtagttataatgtctcatccataggaaatagagacagtttataatgaaaagaagactctgggaccccaaatctctgtggtcaggaagcagactgggaatcccctttagttgcaaacacagtccatttattatagaaaatgaaacaaatcttagagcgtggagaccagttacctggaaggcaaagtcaagaactaaggagatcaatagttaggaaactattcagccgaggaataattgggcccttactaggatgtgttttcttactatggagaagaagactcttacaacgtatacatgtctatatttcagaatttgtaagaaccagtgacttctatatgcctaattccatttcttctctctttttttttaattggaagtgtctattgcaattattctttccctgtcttatcagcacatgttgggtatattgggtgttgataatttattatttgttatttacagttttattgaggtatacataaaaataaaaattgtgtatatttatggtgtatagcataatgttttgatatatacactgtgaaatgattatcaaaatcaagctaattaatatatgcatcagctgacatagttatgctttgtttcattgtgtttttttttttctggtgaaaacacttaagatcaattctcttagcaaatttaagtataaatacagaattgttaactatggtctccatgctgtacattagagctctagaactcattcatcccacataaccgaacttttgtaccctctgactgatattttatttccttccattctacccttgtcaacaggagttctggagggaacaaatattcagaccatagcaaaaggcatagaatataagaatgtaattgtgcacagaaattaataaaacatatttattgcttgatagtctacgtcctatatgcttgatagtctacatcctactcaggaatgcctgtagctagtgaccaattattattgcaatacaaaactcagctcctttgcttcaagtcacgatacacttagaagtataatttatgctccagagtttctcaaatgattaagcattcttggatgccaccaaaattgtatcttttctgggcttcttacctacccttccttttcctgcttccctcactcttacttgtttcttctggtagtacttgctcagtaaataacttgcacctaaatctttgactcatcatctacatctgtaagaacctgtcctaaaataaacatattagtttaagaaataactggaatttttactgacgcctagaatgtggaaacttggaaagagtattactcctacattaataacagtaaaatgtcagtttaaattttaaaaattataacttttcttgaatctgtcagagaactaaggtcttggggaaaccaattagcttggaattcaaggaaagtcaggtgtctccaagcagatgagatagacacactgaaacacatatggcagagaacaggaggaaaatacatcactgtcttgtaagtggttaaaaagaatttatcaatttttttttttcgagacagagtctcgctctgtcgcccaggctggagtgcagtggcgcgatctcggctcactgcaaactccgcctcccgggttcacgccattctcctgcctcagcctccggagtagctaggactacaggcgcccgccaccaggcccggctaattttttgtatttttagtagagacggggtttcaccatattagccaggatggtctcgatctcctgacctcgtgatccgcccgcctcggcctcccagaatgctgggattacaggcgggagccaccgtgcccggcagaatttatcaattttttttatctgaaaaagctcaagtatgggctagcataagagtatagaaccgctgggaggcatggatatcaggggtcttcataatacttgcaggctattctccacagacttctaatgggagcatgattggatacagaaatcctctaacagtggtgcagacttggataaggagagcattcatcgctacacaaacaagcataaatccccatgtaagaccttctcctctatggaacaaaagccttaaattgctggggtaagggcagcacaaaccatcacccccagggcacagatgaagatgaagctagggaaggtacaagaaaaaaacaaaatatctatccctgaggtaggggtaggaaactgtcctggaccaagttcattatatgtctcctaccactaggggaggggcagggaagtctcccatacaagacctagtaaagattcacagcaaaatttggcttctatcggcagatttactaagaaaatatcaacattaagaccaagcttgcctaagttttgaaatggtacaaaaataagaaaaaaatccttttgccccctaacaccaagatcacgaacaccaagtaataagcactaacagtctactactggagagaataagaacatgacaagatccgttgtcaggtgcaagagcaaaagggaaggccaaatgttgagggtagataagggacattaagaaaaacactctggtaatctgattttcaccctacggtattgctaaaagaattttaaactggttgtacactgaaggtaaccatagtaacagcaaaatcccaaatcagctaaactcatgactaggttgactccagtctccacataaacacactggcagaagagatgtgcatctttctttcatttttctttatctttttctttttcttttttctttttctttttcttttttttttttgagacagggtcttgttctattgcctaggctggagtgcagtagcatgatctcagctcactgcagcctcaacctcctgggctcaaacaatcttctcactttagcctcccaagaagctgggactacaggtgtataccaacatgcctggctaatttttgtattttttgtagagacgagattttgccatgttgcccagtctggtgttgaactcctgggctcaagggatccacctgctttgacttccccaaacagtgggattataggcgtgagccatagtgcctggctgcgatgtgcatatttctatgcaaaaatgctatttacttcagtctcgactgtacttttccttcatgtctaggattcagtattaaaacagaaaaaaataaggaaaaaataacccacttagaaaaagcaatcatatcaattagagtcagaaaagaccccgatgttaaaattatcagggaataaatttaaaactatgactaacagtttaaaagttttaaagcatagtttcctcatcttcaaaataattttttaaagtgtcaagtgtcaaattcttatggttattgtgcatattaaatcacataatgttagtgaagtgcatacttaacaaaatatctgacacagggtaaggatttagtaaatgacagtagttgtagtcattattacctgcaatacttaataaaatatggttgactgtccaaatgtgtttgtgataaacttggtttgaataattcctattaattatgcctttctagaaacttttgcaacaataaaataaatgctgcaagggctgattggttttatttcagatgttcctaagcatatctttaagccttaccctacccactccaagctgatttccatcactccccacctccttgctccttgcttcctttgccttaactatattttttgttgttgttattgttgttgttgtttaatcaggactaggagatgaaaggcagctgaacttcgttttcctctgtgatagaaactttgatattggtaactatttcagctctctattcaagaacactggaaagtttctggtcacaaaaaaatgtcagtgacttcactgtagtctgtaccttttttcttattgtagaactcaaaattctaattttccacttattattttatttatctctatcataaagccaaatattccaattaacaccacatagtaatttaaagtactattggaatatactttaaaattattcctatttcccttgaattttgtattgtttatgtaagtaaaattcaattataagtccatattcatatactaatcagtgatatccagttgtaatgataaatgttgtttctaaaactcttttatcattcaaggggcagaaactggattacagaatccatctcctttacccaacttttcagagttttcagctcccttttatttttatgtatcttgagttatttcttctgatagattctgtgccttgaaataatcttcaactaataaaatatttagaatttaggcaatagaatgtgtctatctgtttcaatcatagactctcctctccttgtaaccagactatatttatagtatgaatattattggccagctacccataaccaacacagatttttagtatatctaataccatcatggttgctgtagttctttcaaaatgatgtatcaaaattaaagttaatgacaagtacaatgtaaaagtaaggctgcaaggtatctctgtatttagctgccctgtgttgggatatctactattggaatcttgacagcaaattttactgctcattgaagattattccacatgcacttaagtttctctagctaattcattatagttcctcattaaattataattacttttaaaaataataattattttaagaaggtgaatccaagagctgttgatatcatgtggcttattttccccatttggtgaatgtattagttcgttttcatgctactgataaagacatactcaaagctgggaacaaaaagaagtttcattggacttacagttccacatggctggggagacctcagagtcatggtgggaggcaaaaggtacttcttacatggtgtcagcaagagaaaatgaggaagaagcaaaagcgaaaacccctgatgaacccatcagatttcgtgagacttattcactatcatgagaatagtgcaggaaagactggcccccatgattcaattacctccccctaggtccctcccacaacacatgggaattctggaagacacaattcagttgcgatttgaatgggaacacagacaaaccatatcattccaccccagcccctccaaatcacatgtcctcacatttcaaaaccaatcatgccttcccaacagtcccccaaagtcttaactcatttcagaattaacccaaaagtccacagtctgaagtctaatctgagacaaggcaagccccttcaacctatgagcctgtaaaatcaaaacaagctagttacttcctacatacaataggggtacaggtattgggcaaatacagccattccatatgggagaaattggccaaaacaaaggggttacagggcccatgcaagtccgaaatccagtggggcaaattttaaagcatcaaaataatctcctttgactctaggtctcacatccaggtcatgctgatgcaacaggtgcattcccatagtcttgggctgctctgctcctgtggctttttcaggatatagcctcccacccagctgctttaatgggctggtgttgagtgcctgtggcttttccaggttaacagtgcaagctgtttgtggggtctggagggtggtggccctcttctcacagctccactagtccagtagggtatctgtgtgggagctccaaccccatatttcccttccatactgccctagtagaggttctccatgagtgctccacccctgcagcacacttctgcctgtgtgtccaggtgtttccatacatcttctgaaacctaggcagaagttcccaaacctcaattcttgacttctgtgcatccacaggatcaacaccacgtggaacatgtcaaggcttggggcttccaccctcttaaacccaagctgtacgttcgttggcccctttcagccacagctggagtggctgggacacaaggcaccaagttcctaggctgcacacagcacagggaccttgggcccagcccacaaaaccactttttcctcctgggcctctgggcctgtgatggaaggggctgccatgatggtctctgacatggtctggagacattttccccatggtcttggggattaacattaggctccttgccacttatgcaaatttctgcatctggcttgaatttctcctcaaaaaatgagtttttttttttctactgcatcatcattctggaaattttctgaacttttatgctcagtttcccttttttttttttttgagatgaagtcttgctctgttgcccaggctgcagtgcagtgacatgatcttggctcactgtaacctccacctcccaggtttaagcgattctcctgcctcagcctccgaagtggctgggactataggcacgtgccaccacacctagctaattttttgtatttttagtagagacggggtttcaccatgttagccaggatgatctcgatcttctaacctcatggtctgcccgccttggcgtcccaaatgctgggattacaggcatgagctgcgactggccccatttccattttaaaattgaatgcttttaacagtacccaagtaacctcttgaatgctttgctgcttagaaatttcttccaccagataccctaaatcatctgtctcaagttcaatgttccacaaatctctagagtaggggcagaatgctgccagtctctttgttaaaacagtaagagtcacctttgctccagttcccaacaagttcctcatctccatctgacaccacctcaatctggaccttatttttcatatctctatcagcatttttgtcaaagccattcaacaaatctctaggaggttccaaactttcccacattttcttgtcttcttctgagccctcaaaaatgttctaacctctgccagttactcagttccaaagtcgcttccccattttcaggtatcttttcagcaacaccccacactactggtactaatttactgtattagttcattttcatgctgttgataaagacatacccgaaactgggaacaaaaagaggtttcattagacttacagttccacatggctggggaggcctcagaataatggcaagaggcaaaaggcacttcttacatggcagcagcaagagaaaatgaggaagaagcaaaagcagaaacccccataaacccatcagatctcatgagacttattaactatcatgagaatagcatgggaaagaccgaccgtcatgattcaattacctccccctaggtcccgcccacaacatgtgggaattctgggagatataattaggttgagatttgaatgggaacacagccaaaccatatcagtgagcccccacatcagtggcaaagttaggattgcaagcccaggtcatgtgactccagagtccattctcttaactactctgctatgctgtctcttacaatactttctaggccgtctaactgccactaattgtatgacctttggaaagacccttaaattatcaggaccactgctttcacatatgagaaatggggataataataaaaattattacagtgctgttttgagcattaaatgagttaatgtttgaaagcacttataagtgtttgacacactataagcactgtaaaggtgttggctaaaatgagttcttttaaatattaccttacaattatcttattggtatcagttaacgtttttataagtagattaaaagtttgtacaatttataattaaataaaagaataattgttagtccgtggctggaataagttaggactttgacattaaaaccccttatagttgtgtaattacttgcctgacaatactgagtaagcatgtggctactcaaatcctttataaaagaaattctcgtaatttagtgatattacttatgataggtagcattcactaggaatttagtatgcttcacaagctattcctaatactaaagtattaattctaattaccagaataattccatggaataggtactactattatcaccattttagagataagaaaaataaagcacagagaagtagctccaaattcatagagtaactggtagagatgagacggaagaatttatcatgtcctaagcacttccaatttagccagttttccactcttttcttctcccagcatcgtaaaatctgactgataagtataaataaggaagaaaaaataacatttattctctacaatatagtctcctcactacctgatgctaaatatgaagggacagttctaatgaaagtgatcaacaagttctagaaggaactaaagcttagttccttcctcaacctcagtgaaaagaacaaggttattagtggcgatgtttttcctaggtgtgggggagctaagcattttgaacacagcaaagataaggaagtcggtctgtaatctgcaaaaaggtaagacatttattaaagcattaatcttacctagactggcttggattttcacagtgatctcttgctcatcatgcattttaacaccccttgccacacaaccacttctaaattcttcctctaaaggtaaagagctgtatgttctgagagtaaggaggaaattcctaaaaaagtatctagaatctagaaaattattctctaggtttatgcctcatacatgattgcaaaccatagtgatgatgagcatgtttgtagaactgactttaatggtcttctacaacaattcaggctacatctgcccagagagtgtgtgtggtccacatgttctttcaaatggagaggacctaatcattaagacatagcttttttttttttttcttaactttcaggagtcagatgtggaggatatagagagaattttgacttttagtccatgttgttttccctgacacattttcaattacattgacaactaaaaaacaagaccttggcaagaacatcagggagaaatggtgatgagatgaaaagatgctcagataggcagattttgatatatgactggtcaacagaccttgggaggctctctctacaatgagaacagaagcatccttgtgctaaaggctcatctgcttacaacggttgagataaagaggaatttctcgagctagtggaagaaacaggatgagaagtgtgaaaggaaattaaattttgggattcaaaactcatttagccaaagggaaaagtcaagctgtgaactggatcatgcaaacctgcctccacctttcagttcctaaataaaatggctacaagatgcaaagctactcacctttcccatattttgccaacaaggaaattcctgatgagctgttaaaacttcaccatggcaatgctaattgatagcttatctttataggtgcagtcactcagcctgccagacacaaatgcatatcagattgttcccctaccccattttatttgtgtaatgtaaaatgcagatttcccacatttttcctttgccccttttaagtgaaaactgtgtgcttctcaatatcctgccctttcccctttaaatttggagccctcaaaatcatcttaagagaaaggcatagacctgactcctgggcgtgtccttaactttggcaaataaatctccaaaaatgattaagacttgtcttgtcattttcttcgattcacagaaggcaggatatacaagtagaaagcagaaggcaggatgtacaagacatcactctaaaacctttgaatcaacaaatgaatagcagaaaagcagatgccttgacattgtccttttaaatacacggactcaacaaatatcattgccagctcctaatatgttaggccttgctgatacattggttgactagaaagagtttcctgtcccaatggagctgatattgcagaaaaaagtaaattgtacaattaattacaaatgtgttgaatgctttgaagaagtatagatcattttgagagcctccataatggaaaatttaacctagcttagtcaaacaacacagaaaaaggcatttaatctaaggcttcaagcatgggtagacttcagcttttcaatgtgggcaaaccgatatagagaattcaggcagtgacaaaaaaaaaaaaaaagtagccttaatgtctcactcacaaagctaaatttatggttgaaaatgttaatctatcttctctcatccagaaccaaataaggattgaaaatgtatattttcagaaggattatgttaatgaatatttattgcatgctcttcctgtgccaccaaaacgctaaactctttatattcaacacattatttaatccaagcagtagcctatgtggaatgtgctatcattccttccattttacacatgaggaaactaaacatcaaagcatttacactgtatatatatgataaatccaggaattcaaataaaggtctccctagcacacataccaaactccttccacaatgcttttccacatttattagaagaaaacaggaacaaaaaaagcagtactcaataaaagcaaaataagttaccctggtgaaaaggaatgctgggaggaatgcttttggctatttataatcatacctacatcctcaaaaatccattgccagagtctatttccctgtttaacaatttgtgaggatccttagagaatcaacagcaggaggcaccactgttcagcccattagatatgatccaagatttgtctcagtgcctgactcttctgttctctagtaaggggtctatcaaaacccaatgtacttcatttttagcagaaaggacacatttcccaggggaaattgaaggtgatccttctcaaagtacaaatctagctgttttttgagatgcgatatatcgatgtctggatgaccatattgtgcaagacaattctcttcaggcccaaagttcttttcatatttacaataaaggaatgctatacagaaaaattttcacaaagatcaaaacaattcaaatagattatgccacacaatttcagtgaaaagaaagcttcaacatttacccaaagcatcatcagaaaaccacacttgctagaagacttaatgtctctcatatcacccacagagacatgagtgagtgatcattcccagaacgtgctattcaaagaaaatccattcatcttgttactagttgtcaacttcatgttttaaatctcatttcaatcacacaagaataagacattttctacacctcttagtcaatgaaagagaaatcaatacatgctttttaaaccaaaaatttatatcttcattactgagagaagtcaaaaacagaattatcttaacagtaatagtggtatataacacctctcctttttatttgtttgtgattcttttgttttcttacatagcatataaacagcttagtttatttttccttctactaagtcttcataatcatctcccttagactgagttccaaactctttggaaactactgatgcgttaattggctttttaaattatcttaaaaatataaactttattaattaccacatatgttctttcttttaaatattaatgacttggccaggtgccgtggctcacacctgtaatcccagcaatttgggaggccgaagggggtggatcacgaggtcaggaggtcgagatcagtcaagccaacatagttaaacccatctgtactaaaaatacaaaaaattagccggttatggtggtatacacctgtaatcccagctatttgggaggctgaggcaggaggatcgcatgaacctgggaagcagaggttgcagtgagcagagatcacgccattgcactccagcctgggtgacagtgtgagactctgtctcaaaaaaaaaaaaaaaaaaaaaaaaaatatatatatatatatatgtgactcttcatcaagtagtttctatgaataaaatcagatttcacaaactctgtaaagtgggagaatgaaaatctagtaggttttacttatctgccacaactaaaaattagtatagatttgaggaaatgtcattttgttttgaagagtgtgatttaaaaaaaaatatatatatataatatatatatatataatcttaatttgctttgtcactcatataaaggaaaccgtagttgagttgtagacaatgaggaaacacttgaggcttccgctgtatgtttctttgttattgttatgttgttacccagtaacttgaatattgtttaaagtgttgtaagacattgtagagtttatctcaagctgttaaaaatggtaatgtacaaatgtgaatagacacttatctatataatatgggtaagttttgttttgcctataatagatgtttataaaacaagtgagggagcagttggtatttttatttccttttctttctttctttttattgaaaaatcaagattgtataaaccaaaagctgcaagatgccaaaatcttgtagatgtcaaataaaaagttattttactaaaaaaaaagtgtgcgttggtaatcactactattaataattttaaaaaggataaataaggtcatataaccctgtctctggttcagcaatttggaaaagttgtagttagaacaggagactgttctaatagagagagtgaagagtacaatatgtagtttagttctctcatttggtaggtgcagacacagaaggaatgaaaggctgcatttacacgattagctagatctgtacaaacatttagtactttaacttttctcaaagccttttatgtattatcctatgggtaatgttatcccaaatgtatggataaaattaaaacaagaacactaaatgacttcacaaagacctgaaaggcagatcaacggcataactaatattaaaactcaggactagtgctctgaacatcaaacctcctggatgaggtcttccgtggcacatctctcatttgttgaacagtttttaaaatactgtgtgctgggctttaggttgagagataggacacgtgatttatcccttcagggtgtttgcatcataaagaggcctgtgatcttcaattaatcatgtggccaaagttatttctaggggtcagggagtcattgacaattcattatgccaaatgtgccaaaatgccgaaaaaaaaaaaaccaaaaaccaataatgtaagtctcctgaatataaaattttcaaaaactgaattagaaacatttttttttactctagcaagagcaattcaataaaagcagacatataaaggataattttttaaatctgtgaccaaaattgaatatgagattgattcatctacaaagtgtcttacttttctgtagtacaataaaataaattatactgtcctagacaggcaaacttcaatataagggagatttaatgtcgtctgtcctatcatagtgaaatttgactccactattagtttctgaatactttcatgatttccctcctgctagtttaccatgagacaccatctcagacttctacacagctcatttgcacccatcacaatatataaataaacaggagtgtgccttttctctgccgtatttccactcaactaattcctgtatctttcagctccaccagttctttgtatacttgcaaataatggctgaaaatatttatattttttcttgacttcatatttcttctacacactattagttttcttactctgtaatttaagtgacagatttggagtgggacaaatctgtatgaaaacttataaattaaatttcccatttaatgagaagattttaagtagaggttaattggtaaattactttctcccttttcccccatgctcttttcatattctgattgcattatatgtatgtatatttctagttatgtgtacaactatacaaaatttgggaatataaattcatttcattaacacctgtaccctttttgctcctactcaactcttttttgcacgcaattcagcaaaacttttggaaatagttgtccatattcactggcttctctttctcattttttcacctctcacacaatcctttggaataaggttttcatcttcataattccacagaaacggggaacactcatgttgccaaattcaatagctacctctctaacctcttcttattccatctcttagcacacaacacagttgaccagttgctcatgccctgtttctttaaaaactcctttttcttggcttttttgaaccacacttgtctgtgacagccaccactccttgacagctgtgctgtctccatttgacctctaaatgttaggactgatttgtgttaatagaattataggttacggagatggagccctcacaaattggattagtgtccttataagggccaaggaaaccagagctcttcccctcaactatgtgaggacagagtgagaaggttccttctgagtcatatagtgggtgttcaccagataccagttttgctggtgacttgatcttggacttctcagtacccagaactgtgggaaaaaaaatttggctgtttataaactactccacttatgctattttgttataattgctcagagtaagaaatgaagatatttcatcttacttatcttattattgctatttctccagctttggacacaatacttagcactttgtggaaactcagtatattttttaaatgaataaatacataaatgaattcaccaaataggtagttaaagaaccataaaaatcatcatatccttgttttcgaagtgaattagaaccagctgagttgcacagaattgtaaatcagaacatcttgctgatctttatctctgcatacagacctgattttcatagaactcactgtctgaattacatgtgacaacagatacaaggatgtagatttcactttattttgcaaacatgaatttcatcatctacatagtggatagttgattctccagtgaagtcagatttctgaagtgttaatttaatattgtgctattatactttaaaaaaaaaaacatagcacacatcttctagtaaaatggcacatatctttttgcaatagtcaggaactacagacatgagctaaatcatgtatttgaaaggtagtcccagagtggctaagtcagaataaggtatatctttctttctaaagtactgctttgattatattattttctgctcctcaatccacagtagcacctattagcagttctgcctttggcaattgacatatgttatctcctgttgctatttatcaatttactgtcagttatgttctctctctccaattggactgtaggtttttggcaagatgcaatctggaagtaagctctatcaaaagtagttattgaatagatatttgtaaaagattacgatgaaaacatttctaactctccaaatctaactccaccttatctttagtcttaaacacaacgtgaaaattaaactaaaaacattgaacaaattaatcttgacactgtaatatattgcaatggctaaaataattttgaatcctaaatattaattttgttatacatcttttttatatatatttccctgtatggaacatgttatgaataaatacttgatgttctttacacagtctagagcttgctacatattgttgatcatctcagaaacagcttaataaaatcagcatttgaaaatcccagtatcagcacctgtgacattaataattctggtgaaacaggtgcttcctgggaatttcaaacatttgaaaataaagtgataggccggacgcggtggctcacgcctgtaatcccagcactttgggaggctgaggcagatggatcacgacgtcaggagatcgagaccatcctggctaacacggtgaaaccccatctctactaaacaaaaccaaaaaaattagccgggcgtggtggtggacgcctatagtcccagctacttgggaggctgaggcaggagaacggcgtgaacctgggaggcggagcttgcaatgagcctagatcgcgccactgcactccagcctgggcgacagagcaagactccatctcaaaaaaagaaaataaagtgatacttcgagggaattagttgtgtcacagataaaaatagattgtgcttcactgcactcattttaaaacatagtgactgtcttcaatgctactttacaagtgaggaccagataattaactgaagtttctttctcaagcctgattgcgttgtttctttttcttcactactcttctcctttactgtcccttcaccatttaggaggaggatatgcttttctacacatctgttccttaggaggatggttgatacagctaccaaaaaaatttgtttcatgttttaaagtaatcatcattctcagtaaactatcccaaggacaaaaaaccaaacaccgcatgttctcactcatagatgggaattgaacagtgagaacacatggacacaggaaggggaacatcacactctggggactgttgtggggtggtgggaggggggagggatagcattaggagatatacctaatgctaaatggcgagttaatgggtgcagcacaccagcatggcagatgtatacatatgtaactaacctgcacattgtgcacatgtaccctaaaacttaaagtataataataataaaaaatatgctttgcagagttaaagcaaagaaaaagtcgtaaaagacaaactatattttgtctgtgagagccagcttgttaagacagaaaagttgtttcttttttacatttctaaaacttggttttaaatgtgaagagacaaatactaaaagcaacagaacttaaggtttctctgtaaacaaatgtgtttgtttcagtcataccagatattatgacaaacaaatgctaagtttatgagatttaaaaccatgaaagtatatttttgaatgcattaaaataccgtgaaggtgttaatggttcgtaactgggagtggcacaaaggccagttctgcctcctgaaatcattgacagacactgagctgatggaagatttgtttttttaaatatatctcttttaagatcatcgtgggtgttaacaggtagccaagaatgtaagaaggagaatattaaggttgtacatttgcttaactgccttggtctaggaaaaaaaaaatatcttccatgtactttttagcctgaagaagttacttgaccccagtcagataaaaagaaagctgacaaataaccatatcccaggaataactctgttttctacaagaggactaaaacaggaagccaagggaatgagtctgtggttatcattttctaaaaagtgggctctgtcccctgtcaatttctgaagttgaaattttagaggtagagagaaacagaaaccaacacataggtatgggactcagagaccagagagtgtttgtgctcaacttgctttatggaactcagaagagatataatctcatggagaattcactgctcacacaggctagcatcagcagaattgtaatggtggcaaaacagtatagtccgatatatagattgaaataggacccatcctcagtctatcagaggtccttaacgatgcaggagatcatctgaaaatagcttgtcctgtcccatattgattcaagataggccagagagaccttttagttgcaaaggatagacagagtaaatagcaagtacctaatgactggagaacagggtagcagcatagacatggatatcaagcttaagtagggataagtgttgacaacctacggtatgctggcattggtggggtgaggttttcttctccttagaaaagaattcagttaaatagaggtatagaagaataaatagaagtatttaatgatatggcttagcttggtggtttgaaatacatgcctgctacatctggattctgaatatttctgtatttgtaaccatctcaaaaactccagggtattaataaatttgtccataaatacttaacaattggaaaggcatatggctttagatttaccttttcatttcaggattttactcattaaatcagtattagatgctgcagcataattaagttgaagctgacatttgagaacattatttgtttttctctttcatgacatctaaatacatttgatattttttcccaattgccaatcaagtattcttccactagaatttacttttacctgattttaaaagaacattccaatcatggttggtagccatatggacctctcactcaactacaatgtcagtggctctgggagctatttgtctgtgtctgagtgataaaatctttctcagttccctttgagataattttcctctcattttctactgccaaatggacaatctttggatttctccctgaagtggtctttattctcaagtgaccttcaaatggtttacctctgagatattcccacagcacacccaaagtgaagatatagccccttcaaagttggcaacaatacatctagaagttttctcatggtggtaaaatagacaataatttcattttttctaaatagactcactcaagtcaatatccacacagcttcccacacacaataacccattccttttgtatacccttggtgccttagtctaggtcttttttctgaccatagcatccttcattatcttttcagatctcacttctttcaacatcaagccttcttatgtccagtgataagatttatgtctttttgtaagaattttatgtatttattaaaaacatcatttaattgacttaatcagtttcattgggattacttttaaatctttattaaagatccttcagagcaagggccattttatacatcttttttggtaatttttctatattgttacctaagttcacattatcatagagattaatcagaccacacaaaacagtgaaattgatagtgactatagagttagcctgagtgttcagtacaggatgactggctccttttgaataataaagatgatctctaaaataatagcatatatctcattaatacaattatgatatcttgaactgtgcaggacaaacagtcctatttttattatatgaaatagtctttgtaagtatctaattacctacttcccttgataacactgaaaaaagaccttgaatcttaaaaatttccactttaaagtaagtatagtgcaaggacagatcaatgtagtactatgtttttatgccctctctgcagcgagtttatatataacctgaacttttcatagctcccaaatccaaaaaaaaatgcttgcaaccataatttactttttacatttaaactatcgacaataacttcatagcactggtccagttgctcatttcacttgtgaaaggggtcaaattttcacctagagttttattgaatgccacattttatagtaactgttactcaggcttattgtttctcacagttgtttgtttatttttgtgtgtgtgttgttttctcctatgtttatcatcacggttgcttcctgaggaacttttgctagtcgtcgcttcaaagtaatatctccttttcaagaatgggtaacttgataacaatgaaacaatcaaggtattgactcagaaagacttaaccaatgtaaacacacttctctttactgatattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtctcttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgttgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctataaacatatgtgtgcaagggtccttttcatataatgacttgttttcattgggatatatacccagtattgggattgctggattgaatggtagatgtacttttagctctttaaggaattttgatactgtcctacatacaggttgtactaagttccattcccatcagcagtgcaagctgctttttccctacatccaccccaacatatattgtttttcgacttttcaataacggctattcttgcaggagtaaggtgctcattgtggttttaatttgcatttccctgaagattagtgatgttaagcatttattcatatgtttgattgctgtttgtgtatcttcttttgcaaaatttctattcatgttctttgcttactttttaatggaattatttggggttttttccttggtgatttgttggatttccttatcgattatggatactagtcctctgttggatacatagcttgcaaatattttctcccattctgttgatcatctgtttactatgttatttcttttgccgtgcagaagctttttggtttaattaagtctcatttatttattttggtttttgttgcatttgcttttgtggtcttagttataaattctttgcctaggccagtgtctagaagagtttttgtaacactgttttctagaatctttgtggtttcaggtcttaagtttttgatccattttgagcttacttttgtatatggtgagagttaggaattcagtttcattcttctacacgtggcttgtcagttttcccagcaccatttattaaataaggtattccttcaccaacttgtgtttttgtatgctttgacatatcacttggctgtacatatttggctttatttctgggttctctgttctgtgccacgagcctatgtacctacatttataccattgccatgttgttttggtaactgtacccgtgtggtacaatttggagtccagtaatgcgatgtctctaagtttgttcatttgcttaggattgctttggctatccagcctctttttaggttctaaattaattttaggcttgctttatttttctaattctttgaaaaatgctgttaggtgtttgatgggaattgcactgaatctgtagattgctttggcctgcatggtcattatcacgatattgattcttccaatgaataaacatgggatgcatttccatttctttgtgtcagctatgatttctttccagagtgttttgtagttctccttgtagtgatctttcacttccttggttaaggtatattcctggatttcttttttatttatttattttttattattgacagctgttttaaaagggattgaattcttgcttttattctcagcttggtcatttttggtgtgctactgatttgtgtacattgattttgtaatctgagactactcaattcatttatcaaacctaagtgtctttggaggagtcttaggattttctaggtattcaatcatattatcggcaaacaacgataacttgacttcctcttttccaatttggatggcctttatttctttctcttgactcattgctctggctagtatttatagaactatgtagaataagagtggtgaacgtggtcatccttgtcttgttcctgttctcagggggaatgctttcaacttttcctcattcagtatgatattggctgtgggtttttcatctatagcttttattattttgaagtagttttcttctatgcctagtttattcagagtttttatcataaaggggtgctggattttgttgaatgatttttctgaatctattgagatggtcatgtagttttgtttttaattgtgtttatgtgatgtttttaattctgttttctgtgacgtattctctctcgatgaatctagctaatagtctatcagttttattttttcaaacaatgagttttgcgtttcattgattttcatatatttttgtgtttgaattttattgagttctgctctgatctttgttatttcttttcttcttctagctttaggtttattttgttcttgtttcttctgttccttgaggtacgacattagatcgtcaactgtgcttttttagactttttgatgtaggcatttagtgctataaagttccatcttagcactgcttttgctgtactcgaggttttgataagttattgcactattattcaattcaaagaatttttaaagttttgtcttgactttattgttaaccagataccattcagaagaagattatttaatttccatgtctttgtatagttttgagggttctgaaactgcctttgcaaaattataactgaggaaattatgacagtgcagtgaaataaatcagaacttactaactctatcttgcttctaacccttaagctgtccttgttcattcctgggtgtaggctggactaactttgggaaggaatttagttcatggtttgactctgaaacaaaactgataacaaccctttcttgcctggtgtccagtctgctttttcaggactaataaattagctacaagattaaaaattataatttaggggtcatacagcctctggctccaagagtctgaaaatccacaaattgctcctagggataacaccactattgtaaaacctaagatcagtgcttgagatattttgcagaccctgaactccatagatcagccaacaccacccagaccagtaatctggcccaaccagttctgccaatgcacccaagtacagaagacattaagaaaacctaactttgacctcctatggttccatctccaacttgaccaatcagcacttcccatttcccaagcccctacccaccaatttatctttaaaaagtctgattcctgaattctcggggagactgatttgagtaataataaaactccagtctcccgcatggccagctctgcatgaattattttttcaccactgcaattctcttttcttgataaatcagctctgtctaggcagcaggcaatgtgaaccaattgggctgttacagttctttgtgaagttgatttctagttttattctgctgtggtctgagaagatatttgatataatttccattttaaaaaatttattgaggcccgttttgtgacctattatatgatcagccttggagaatgttccatgtgaagatgagatgaatgtgtattctacagatcttaaggtaaaatgttctataaatacctggtaagcccattagttctagtgtatcctttacatttattgtttctctgttgactttctgtctcaaagatttgtctagtgctgtcagtggtatatagaagtctctcaccattactgtattgctatctcattacttagatgtagtagtaattgttttatgaatctaggagctccagtgtttggtgcatacatatttaggattataatatctacttattgaatttatccttttatcacatatgtagtaatgatctttgtctttttttaaatttttgctgctttgaaatctgtttggtcttaatatgagtatagctgctcctgctcacttttggtttccatttgcatggaataccttttcctacccttttactttgagtttatataaatccttccctgttaggtgagtctcttgaaggcagcagatatttggattgtgattttttaaatccattctgccattctgtatcttttaaatggagcatttaggtaacttacattcaacgttaatattgaaatgtgaagtactgttctcctcatcgtgttaattgttacacagatagtttcttttcattgcattattgttttataggccctgtgagttttaagcttttaagacattctattttgctgcatattgggtttttgttttaaggtttagaacttcttttagtatttcctttagtgctggtttggtagtgacaaattccctcagcatttgtctgaaaatgactttatttctcatttatgaaactaagttttatgggaaacaaaattcttggctgacagttgttctgtttaagaaggttgaaattaggaccccaatcccttctggcttgtaaggtttccgtggagaagtctgttcttagtctgataggttttcctttatggtttacttgatgcttttccttactgttcttagaattctttctgttgactttagatagcctgatgactatatgtcttgctgaagatctttttgcaataaatttcccaggagtcttttgagcttcttggatttggatatctagatctctagccagaccaggaagttttcctcaactattccctcaaatatgttttccagatttattattttcacttctccctcaggagaaggaaagccaattattgttattcattttatgtatttccatatttcttagagactttgttcatttttattcttttttatttttgtctgattcagttaattcaaaagccttgcctttgagctccgaaaattctttctcctagttgttctagcctattgttaaacatttccacggcattttataattattgcccaagtgtatcttttattttcagagtttctgattaatttttctttacgatatcactctagaaaatttttcattcatatcctcaactgccttctaaatttctttatgattttttttttgcctttctctgatatctccttgagtagcttaataatcaaccttctgaatttatctggtatttcaaaaatttcatcttggttgggtccactgctggagaactagtgtgatcttttgcgggtgttatagcaccatgttttgtcatattaccagagttatttttctggtccttctcatttgggtagactattttttctaattattctttattttacatttgatttaattgtgtttcctttgtttgtttgcttttaatttttttcctctttaaggatgagacttcaatgctttgagttaattgtagcctaatttggttcttggtgctttcagggtcaaagactctgaagagtcccttggttatagaaagtgtttgtatgatggctttctcatatgctggtatagtagcaatgggctcagtgtggaaacaaattcagtatctcctatggggttggaatggtagaggtctcttaaagcttatctcattcccctgtggtggcactttatttatttatttatttccccccatattttatttactggtttgatggttcagatttcaggccagtaggggaggtatccctgggtagggaccagttgtaggtaaagcaggtggataaataaagtcccagcattgacagaggtaagtggaggagcttaagtgagttgcactgaggttttatcaagtgaagttttggaaccactttagctccctgccaggtcagtaggaaagttatccacctctcagacatgctactatcccagtgttctggttattcagatcaggcaggcacccttttcatctgtagaaatgttgaccttccaagtagagaggaattgtgactctgtctctcatgcaagcctgaacccaggtagtgctccttctgtggggatgcagtaccctgatgtgttccagaaatgctgtctatggttgcacccatactgagctcctgttggagaaacccaaactgcgcctatgatggtggataaggggggaaaggcttcctcttctccagtactcttcatggataccaggactgtctgactgttggaactgtctgactgagagctgaagaccttccctgcctagccccgcacctcaacagtactgctgctgaaggaagctttccaccagtggaaggatcctgtggtcaaggcctgccatctggattcttttgtcttacagtgtgttctcttggggttggaatggtagaggtctcttaaagcttatctcaatcccctgcggtggcactttatttatttatttatttccccccatgttttatttactggtttgatggttcagatttcaggccagtaggggaggtatccctgggtagggaccagttgtgggtaaagcactctcccttcccctaggagtgggaatccctgggagccagactactgtgggtgttgttgctcctctgggtctagctgctcagtggaattgccccactccaggctggtgttggggaaatgtttgcaagggatccactgatgtgacctgtcctcaagttttctagcagtgggtaatggcaccagctctaatgggagtggcaaaggagtgacatagattctgtgaagttccttggttattgatagtcttagtgtgttggctttcttgaacactggttatagcagtgatgaactggtcacatggacagattcaggagcccctggttagccagagcggtgtaggcaatggtgatagctgagatgcacagccttctccttcttggacacggtgttattctaccaagaaatacagtaatggactgtgtcggttgtcctgcagccaggaggtggtgcttgccaaaaagcatcagctgtggtggcaaccgtggcagttttgcttgccttatgtttcctgttggaggggagtatctctgatttctcaggcaatgggcagggccaagtagctcccaagagattttgatctttttgttgagctaccagggccgatggcagggcaaagccaggtgggagctgggttgggcaggtttgcattctgagtctctgtgtgtagggcaaacagcagcccctgtgggtttttggggacaggggcaggtttcaaaccgctgggttgatgttccagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttggtaaggcggtaatcagcactcaccactaacagtagtcataagattttcccacagagaaagcaaccatggcttttaggccttgcccttctctgtctgctgcaaagccaggcacctggcatctgcacccagggctcctgcacccatgggcctacactcatgactcttgcactcatggcacgcttttcactctccccatcctggccctggccaagggagttcgtgtccacccaaagttatattattaaatccctttgggagcctctttctacctgtggccaccacttgaaatgtttggctctcttcctcagcaccctttgtgaggaacagtaaagaatagctaccctcagttcacactgggatctaggagtccatgcaagggtcttcccactgctgatcctacttttatactccatgaccctccccaactctgtttctgcacagggtggggttagggccttcccccgtgtattgagctttcagggtccccagtgggagtgtatatcctagaggcaaactctccccttctcatactctatgtactcacagcctttgcctgactcacactgtaggctgcagcctctagcatccttcaaagtgtccataaattcctccggttttcctgttcagttcctgtgtcacttcttgaaaaaaattcacagtgtgaatctctgcacactattttgtccttccaagtgtgagagatatgctagcaatgccttcaatccaccatcttggggggaaaaaactctaatttgcttttaaattagattttgtattaagacttttaataatcaaaataatcactgaatgctgaactgaatttttaaaatattaaaaatagcaatagttcagtctgttaatcactaacctaacatacacatttattaaaaccctatttccaaagttgaactgtaattaagtttgtatggagagattcacataaaagttaccccattacttctttagtagtttttttgttgttgttgtttgtttttgtttttgagatggagtcttgctctgttgcccaggctggagtgcagtggcaccaacttggctcattgcaacttctgccttgctggttaagtgattctcatgcctctgcctcccaagtggctgggattacaggtgcccaccactacacctggctaatttttgtatttttagtagagatggggtttcaccatgttggccaggctggtctcaaactcctggcctcaagtgatccacccgcctcggcctcccagagtgctgggattacaggcgtgagcgaccactcctagaccctttagtagttttatagtttgggctcttatgtttaagtctttaattaattaagatttttttaatatggtgagagatagggaatctagtgtcattcttctggatatgaacatctgttttcttcctggaccatttatcaaagatggtatctttcctcaatgtatgtttttggagcatttgttgaaaatgttccaatagtcacaaataaacattctattaaaaaattttttgaataatggttagcatctacattacagttaatagctaggtcttactgttaataattgactaatgaactgttatactaatattcactttcaaaaccatcataaaaaaacagttttatgaaatagatacttttagaattaatggttaatgaaaacattcatttttttctataaagttatttttgtgtaatattttttcttttttattgatacgtaataatagtacatatttaagaggtgcatgtgtgattttactacaagcatacaatgtataatgatgatcaattaaggtaattaggatattcatcacctcaaacatttatctttttgagtgttgagagcatttcaaatctttacttccagctattttgatatatacaataaactattgcttatgtccccatccctaccctcatttatgcactttttccagcctctggtacctatcgttttaccctccctacatgagataaactttttaacacccacatatgagtgacaacatgcaatatttgtctttttgtgcctggcttattttacttaacatagtccatcagttccatccatgatggtacaaatgacagagtattatatttttatggctgaaaagccttttatttataaagtttttatctgttaatctgttcacaaacacttgtattggttctatatcctggttattgtgaacagtgctgcaataaacatgggaatgcaggtatctacttaatatactgatttcctttcctctagataaatacccagcagtggcattgtggggtcatatggtagttctatttttagatttttaaaaatgaacctccagactgtttttctataatagctgtactaatatatatttccaccaacagtatataattctcttttctccatattcttgctatcatttgtgtgtgtgtgtgtgtgtgtgtgtgtgtgtgtgtgtattttgataatagccatgctaattgggtcgagataatatcttactgtgattttgatttacatttccctgatgattagtgatgttggcatgttttccatattcctattgaaaacttgtatgtctacacttgagaaatatatattaatattatttgcccagtttttagggagattatttgattattctgttgttgcattgagttcctcatatattctgcatattagtcccgatggatgaatagttcacaaatattttttccagttctacaggttgtacctttactatgttgaacatttcttttactgtgtagaagctttatagtttaatatagtcccatttgtctatttttttgttttgttgtatgttttgaagtcttagtcataaaatatttgcattgactaatgttttgaagaatttctcctatgttcttgtttagtagttttatggtttggggttatatttaagtctttcatcaattaagtttttttaatatgatgcaagatagggaatctagtgtcattcttctgcatacggatacctgttttctccaggaatatttatcaaaaatggtgtctttcctcaatatatgtttttgaaacatttgttgaaaattggttggctgtaaatacaataatctatttccaggttttttattctgccctgttggttaacgtgtctgcttttgtgccaatatattgctgttttggttaccatagcttagaagtatatcttgaactcaggtagtgtgatacctccagctttgtcttttttgcttaggattgctttggctatttgaggtttttacggttacaatttttcttttaatttctgtaaagactatcatttgtattattttttttgagacagactctacctctgttgcccaggctggagtacagtggcacaatcttggctcactgcaacctccacccttcaggttcaagcaattctgctgcctcagcctctcaagtagctgggattacaggttcacatcaccatatctcgctaaattttttgtatttctagtagagacagggtttcaccatgttggccaggctggtcttgaactcctgacctcaggttaactgcccacctcagcctccaaaagtgctgggattacaggcatgagccaccatgcccagattgtattttgataggaattgcattcaatctgcagattgctttcaatagtatggtcattttaacaatatcaattttttcaatcgttgagcatggaatatttttccatttgttttcatcctcttcaatttattttatcagtgctttgtagttttcctaatagagcaattttcatctacttgtttaaatttattcctagttatttttatagctcttgtaaatgatattgttttcttatattcttttttttatctagtttgttattggtgtatagaaatgctactgttttatatgttgattttgtattctgcaagtttactgaatttgcttatcacggctaagaggtttttggtggaatctttaggattttctatataaagactgtgttatctgcaaaaagagacaatttgtcttcctcttagattggagtgtgttttctcttctttttcttgactaattgctctggatatgatatcaagttctatgttgaataagagaggtgacagtgggtatccttgtcttgttccagcaggtttccaccttttctcaatttcaccttttctcaattcagtataatgttagatgtggtttgtcatatgtggtctctattatgttgaaatatgttccttctatgcctaattagttgacagtttttatcatgaaaggatgttcaattttatcaaatgttttcctgaatctattgagatgatcatataatttgtgttcttctttttttttcttttttttgagagggagtctcactctgtcacccagactggagtgcagtggcacaatctcggctcactgcaacctccacctcccaggttcaagagattctcctgcctcagcctcctgaatagctgggacaccaggtgtgcacccccatgcttggctgatttttgtatttttagtagagatggggttttaacatgttggccaggctggtcttgaactcctgacctcatgatccactgcctcggcctcctgaagtgctggaatttcaggcatgagccaccacaccgggctgatttgtgttcttctttctgttaatgtgatttatcaattctattgattagtatatgttagatcatttttacatccctgagataaatcctacataatcacagtgtaccacctttttcatgtattattggattcagtttgagtactttattgataatttttgcatctatatacatcagagatattagcctgtaattttcttttttgttgaattcttgtctggttttgtaatcaggtttagctggccctatacaatgacataggaagaattccctcctcttcagtttttttaaatagtctgagaagaatagatgttagttcttctgtataggtttggtagaattcagcagtaaagccattcagttctgagcatttctgagttgggaggtttttttcagctattattgcttttgattctatctctcttatagctcaaataatatctgtttttcctatcagggtgctgtggtgttggtgaatataccttcacaaatgttatatactcttgaaaattgattcctttattattatataatgatgtcctttgtctttttttatgtttttgacttaaagtttattttgtgtgatgtaagtgaagctactcctgcacagtttttgtttccctttgtgtggaatattcttttctgttccctcactttcaatctatgtgtgtcttcacaggtaaagcaagtttcttgtcaacagcatatagttgggttttgtattttttatccattcagccagtacatactttttaagtaaggaatttaaaccttttacgttctggaatgttattgataggtgacaacttactcctgtcattttgtcaattattttctaatgttattgtatattgtttctttcattctcttattttttacatttacaatttgattatttttgtagcaacaacatttgatagctttctctttctcattcgtgtatatactctaccagtgaacttagtacttttgtgtcttttcatgagggtagatatcttttcactcccagattttgcattttcttaagcatttcttaagcatcgtaggatcaacctattggtgacaaattcccttggtttttcttgcctgagaaaggctttatctctccatcattttggaagaatagctttgcacagtttattattctttactgccatgttttgttctgttttgttttgttttgttttgtattgttagtactttgaatatcccattctttcctggcttataaggtttctgctgaaaaattttgagaaattagctgttgatctgatggggatttccttatatttgatgatgttttttcttgctattttgatggttttactctaccttaaacatgaccttttagaattgaatctacttgggaatatttgttgcatttcctgtatctgggtgaattcatgtatatggatgcttcttataaatggatgcttcttataaatggatgtatatattttgttcaagacttgagaaattttaacctatcattttgttacataagttttccatctctttttctccacaattcccaaaatttgaatatttggttactttatggtgtcccatatgtcacataagctttcttcattctttttaagtccttttttcttcttttgtctatgacatttcaaaagacctgtcttcaagtcagaaattctttattctgcttgatgaagtctattgctgaagattttgattgtatttttatatcactgattgaattcttcacttcaggatttctgtttgtcttttttatcatatctagcaatttatcattcagattataaattattttctaatttcccaattgtttatctgtgttatcttgtatctggctgagttcttcaatattattattttgaattcctttttagatattttatagatttttcttttttgtgatttcctactagagaattattattttccttcggtggcattatgtttccttgctttttcatgtttcttgcatctttaaattgacatatcagcacatcctgggtgacagtcacttacttcagttacatggattggcttttacgtggaaacactttttttcaattgctgagcagttctgctttttaaagcagcaactgagctgtaaagcagacccatccttagacaggaaactgaatctacgtgggaggaagacacagtggtgggcaatctggaagctagaaggaaggacagtcagagtgagtattgtaaagccagaagcatggcttatctaacaccccgctgggatatctaagagagcccccttctcaggtttttttctgtctcaaaagaaactgaggcatgggtagtgataaaatcacaagtaatctcaccctaccaaaacccagtctcctcattaaatgctacagaagtctggaaggagttctcattatacaggcctatgacactctcactgtccaacagtcttcatttctggttttgttcaagattatatccctctcacacacaaagaaagcatttatcatgagagaattttggtactttatgaagttgtctgcctttaattatttatattgtcttctttctcttagtatttttgttttttttttctttagggaagggatagaggggactgtttttgatattgctattcttcttctgtcatctaggtaaagcttcctttgaaaatgccaacctgtttgaacactcctcaggagacatgatgaaagatgttctctataatttatctgtatattcccagtttccaaatatggcaataacagcaagaataaacagacggatatctcaataagatgaaaaattagcaggaactgatgaagggacactcttatcgctgttgctttccattatgattgttgaactcaaacagctcttcctgtgtctcaggcagaatcaattatagatagaaaattaacttacaaatatctttatttacttgattaggaaaaggatactgagtagtcagcaagtaatagttaaaaagaaatcataaaattggaatcacaagatctgtgttccagggcttcctttgactttaaaaagtggattacccttaactgagtcacatacttctttaagatttttttatatcatcatctgtacaacaggaacagcaaactagaagatctctgagatccccttaaattttaaattgtttcaaattataccctaagatatctgagcaagaaagatttaaagagcaaaattttacctcaacagagatgagagtttgttagtgtaattgagggggtcaaaacaaaataatatattgttaaatagtgggtgaagacttagagtgatagaagtcttttccataaaaaaatttagtttttaataaatcctttcactgacatcaacacagtaataaaggagaagcacctataacacggcttcaatagcaatttttacagcaatgtgtaaaacatgccatcagagaagaattcctgttccttaaatttccacgttacccagcatctgccatagctaacaggaaatgaaatagaataaactatggaaagatattgaataaagactccttaactatggagtttgataatttgaagtaaggaaataagaattctctgcttttagaataagaaacataattccaacaaatgaaaaatctactgtttctccctgtggaatgtgaacaatctagcataggtttctgaagggaacctggcgctatggtagaaaatgatcagaactgtattgatttacatatgtttcttactcttataggcatataggagccttgcatgaccacactttaaacaaatattttcacagtatttattattgatagcatacatgcattaaattgttttttataaactctaataattaacttcataaaccgtcttaaataaatgtttttcttatttgtataatgaccttagtttaaaatgtaacctttcagatattttcagaattacgtacataaagagggtgaacctatcttagaaatacaatagtttccgctttccagaacaataagactaatgaaaaaccgctttaaataatgttgcttgagggatggtttctctctaaacaccagaatgtgtagaaaatgtttacacggcaaaataaataacctgttaagaggcttaaaattttagttagaacaataatatacacagtcaacataaaagccttgtttacatggttgtttgggaatattttaaaacaaaaacagtttgcttcatattcagatctcccatggctcccaaagaagactttagttagagaaaaagagttgtttaaataaagagaattcatttatttctgttatagtgtaataataataactagtcatttatagttattcatacatttgtataatttgaacaaaagccatcagcctgaggctttctttctcatttctgcaaataaagatatagagtgtttgaggaattcatgtagtttgcaaatatttgcttttggagacaaatgatgataattaaataaaatgctgtgtgttttgttgaatgagcaatgtaataacatttaggcatgtaaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgcattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaaagggatgaaaaagcatatttcatgccaatgtaaaccaaaaaggagcaagagttgtgatacttatatcaggcaaaatagatttcaagactaaaactgcaagagacaaagagggtcactatataatgataaagggatgaattcagcaaaaggagataccagttttaaatatatatgtaccccaacatttggagaattgagatatataaagcaaatattatagctaaagagagagatagacctcaatacaataatagctggagacttcaacaccccactttcagcattggacagatctactgaacagaaaatcaacaaggaaatatcaggcataatttgtactagagaccaaatggatctaatagatatttaaagaacatttcatccaatggttgcagaatacacatttttctcctcagcatattgattattctcaaggataggccatgtgttaggtcacaaaacaactcttaaatatttcaaaacaaattgaaataatatcaagcacattttctgaccacaaaggaataaaactagataataacaagaggaatttgaaaactacatgaatacatgaaaagtaaaaattgtgcccctgaataaccagtggatcaatgaagaaattaagagaaaaattagaagatttcttgagacaaatgataatgaaaacacaacatacgaaaacctatgggacacagcaaaagcagtactaagatgaaagctgatagctctaaatgcctacatcaaaaaagagaaaaaacttcaaatatacaatctaatgacgcatcttaaagaactagaaaagcaagagcaaatcaaacccaaaactggctgaagaaaataaataataaaaaatagagaagaaataagtgaaactgaaataaaaaatagaacaaaagtcaacaaaacaaaaagtagtctttttaaaaagttaaagtaagtggacaaatatttagccagactaatagaaaaagagagaagatgcaagtaagattagaagtgaaaatggagacattacaactggtatttcagaaatttaaaggatcattagcagctactatgagcaactacataccaacaaattggaaaatctagatacaataaatgaattcctagacacatacaatctaccaagattgaataatgaagaaatccaaaatctgaacagactagtaataaataacaagatcaaagccataacaaaaagtctcccagtaaacaaaagcccaagacctgatggcttcactgctgaattctgccaaacatgtaaagaagaaataatatcaatcctactcaaactattctagaaaataaaggaggagagaatacttccaaactcattcttcgaggccaatattcccctaatgccaaaactggacaacaacacattaataaaaaataaaacctataggtcagtatctcttataaatattgatgcaaagatcttcaacaaaatactagaaacccaaattcaacaatacattagaaagatcatccttcatgaccaagtagtatttatctctgggatgcaagtatgattcaacatatgcaagtcaatcaatgtaatacatcaatagaatgaaggataaaaagcatctgatcatttcaattagtactgaaaaaacattttataaaattcaatatccctttatgttaagaccctcaaaaaactgggaatagaaagaacatacctcaacataataaaagcaacatatgacagacacacatctagtgtcatacggaatggggaaaaactgaaatcctttcctataggatctagaacatgacaaggatgcccactgtcaccagtgttatttaacaaagtactggaagtctttgctagagtgatcaaacaagagaaagatataaaaggcatccgaattgaattgaaagaagtcaaatttttcttatttgcttaggatacagtcttacatttggaaaaacctaaggactccagaagaacactactagaactgatcaacaaattcagtagagttacaggaaacaaaaccaacatacaaaaatcagtagcatttccatatactaacagtgaaaaataaaaaaaattaaaaatagtcccattatactgaccaaaaataaaattaaatgcctacgaattaatttaaccaaagaagtaaaagatctttacaattaaaactataagacactaataaatgtaactgaagaggaaaccaaaaaatggaaaaatatttcatgttcattgattggaagaatcaatattgttaaaatgtccatactactgaaccaacatataggtttaatgctcaaaataccaatggtattcttcatagaaatagaaaatacaattagaaaatttatatggaaccacaaaagacccactaccctaagcaaatagaacaaaactgagggaatcacattacctgacttcaaaaattttgctacacaactatagtaacaaaaatagcatggtactggcataaaaagagacacatagaccaaaggatgaatgttgagagcccagaaataaatctacacaccaacggtgaactcattttcaataaaggtaccaagaacatacactggagggaagacagtctcttcaataaatggtgctgggaaaactggatatctatatgcagaagaatgaaactagatccttccctctcaacatataaattaactcaaaatggattaaggacttaaatctaaggccccaaactatgacattggaaaaatcttcagaacattggtctgggcaatttgtagtgcactgggagtgtcataataccttgttttttcatatttcctgtattattatgctgattttttgcatctggagaaatagttgcttctatttatttttgaatttattttgttggggtggggctttttccccctgagaatacaacaatgatgtattttgaatagggccgtatggctttgcttctgagtacattcattgttaaagactgcttaagttttttggttataaatagccttaatatagtggcttcctcaaatgctggtagtagtagcaagagagcttgtgcacagcaaccaaaataacagagtaaacaacaacctacagagtggaaaaaagtatttacaaactatgcacatgacagaagactaatatccaaaatttacaaggaactcaaacaactcaacagcaataacaaaataatcccattataaagtgagcaagtgacatgaatagacatttttcaaaagaagacatacaaatggccaacaagcatataaacaaacattcaacatcatttctcttatcattagagatacgcaaatttaaaccacaatgagatataattttaccctagtcagaaagactattattaaaaagtaaaaaaataatagatgtttgtgaggatgtgaaggcaaaagaatgcttagtaaattaatacaacctgtttggagaacagaatggagatttctcaaagaactaaaaatagaagtaccatttgatccggcaatcccactactgggtatctacccaaaggaaaagaaaatattatatcaaaaatacacctgcatttgtatgttcattgcagcactattcacaatagcaaaaatatggaatcaatctctatccattgatagatgaatgaataaataaaatggcgtgtatatagataaaatgctatgtgtagatacacacatgcacacatacatgtatgtgtatatatgtacatatatacacatatgcaaacatatatataacatggaatactattcagccataaaaaaagaatgaaataaatgaaatcatgtattttgcagcaacatagatgaaactggggacattatcttaagcggaacaactcagaaacagaaaatcaaataatgcatgttctcatttacaagcagaagctaaataatgtgtatatacggacatgaagtgtgtaaaaagagacactggagactcagaagggtggtgaaggatgagaaattacttaatgggaaaaaatgtacattatttggttaatggttacactaaaagcccagacgtcactattacacattatatccatgtaaataaactgcagtgtaccacttaaatttctacaaaataaaattaggaatctttgtttataacagaatgaaaaaaataagccactgattgggaaaagctatttgcaatgcacatacagtaagaggcttttaatagactaaataataaaccttcacaaatatataaaaaacagaaaattcaatagataaatgggcaaaagctcacagattcttcaaaattaaataatactaaaatgacaaataaacatatatagattctccacttcattattattcagagaaatgcaaattataaccatagtgacctatcattatagaactgttaagtttaaaaagactaataatggaacagctggtgaaaatgtagaccaagagaaacttatggatacttcaagacatcgtgttgtatatgataaatacatacaatattatgtgtcaaatttaaaaattaaaaattaaaaaataccatctgagggatgtgagatattgaattcttaatacaatttaaattttcttaatgttgattcagattataatgatgaagataattttaacagtgatttggtgaatgataaaaaatagctagctgttttacaaacggactacttaaatgatgctataatgtaaaagcaaattacacaaagtgagatttaattaaggaggatataataatacctcacattttttgattttttaaaatagaattgtgtttagcagttgaattgtcttatttaatattcataaaagcctgggcaccagacactatcatcaaacataatttagaaataagaaaacccaccaggcgcggtggctcacacctgtaatcccagcactttgggaggccaaggcaggtggatcacaagatcaggagatcgagaccatcctggctaacatggtgaaacccgtttctcctaaaaatacaaaaaattagccaggcgtggtggtgcgcgcctgtaatcccagctactcgagaggctgaggcaggagaatcgtttgtacctgggaggaggaggttgcagtgagctgagatcgtgccactgcacttcaggttgggcagcaagagtgaaactccgccaacccatcccaaaaaaagaaataaggaaatcaagtattacagagcacaagcaacttttcctaatgttaggtctaggatttggaagtaagcagtgtcatccagaatttgtgttcttgctatatagaggaagtcaaaacaattacctaaacaaaaactgatattcaagattttcaaattaggcaaagttttagtaacttgtattgataaagaaaaactgcctagaatatcaataaagatttatgaattttcaggattaaaaggaacctaagatgccattctctagctgaacactatttcatcttcctttggacatcattgataattggctcttcattcatgtgaggctccacacattagaaaaatattcctttagtagagctgaaatttgtgttatgttttggtttgttttagcttccaatgactgaccctaactctgtccctgattaatttgcagtctaatttatattatactgggtcgttctgaaacaattagataaacctatcaagtcatacataatttcttctctaaatatttcctgttgtttcatttttttttccacatggaatgattcctgatacctttcctcagggtatgctcatttgtcaacatcccttattgataaaattggaaaatttcttaggataattgcatatataaagagataacttatgtccaatatctgggacatgataaaatctctcaaatttccttaagaattcaaagctgtgatagtctcatttgtgtgtggagtagtcccctcttgaaaattacaaactttatttgtttttaatttatgaatgtttctttatttttcctttgggacaaagaaagaaaaaagtatgcatgagcactatctttttcaatataagattatttatttaggttatatttctatgaatggaattgatggataagaaatcgtctttttggatagagactaagttgctgtaatgaagaaaatcccaaaatacaatcaatggcttaaatatgatagaagttcatttctccatcaggaaacagtataattaacagggtaaccctgcctcatgagaacttctagggagggtggttttctccatcttgttctctatcaactaataagacattgcccttatcttcatgaccaaaattatatcattgcaaaatctgctttccagtctaaagaaagcatcagtccagaacaagagatttcacttttattataaattgtaactgacctggaagctgcacacgtaaattttgttctcattcccttgaagagaatggattcaaacaagacaggttggttgtaaggaggctgaggagtgtggtctccagctgtgaagccatatgcattgcttcagctcttttcctgtgaaaagagaacaaatcaaaatttagtgtgtcaaccatctctcctacagagactacattcttttgtttccatgaatctcgaaataattttcaagattctttacaaatgattattatctttaaaatattagtaaccatattaatctgtagtgtaaaaatcaaatttttaagacaagaaattaataataaaatcaatatcgtgtggtaagaaatataattgactcattaagtaaacatctcaagttacagaaacagaagggtgtgagcatattagaaatgtgtatgttgaccacaagcatttgtgctgtcacaggctttagtgagtataatttacttaaagactagagagcaaaatttatcttgcaggttttttcaatgtggtcagttaaggcagcttctcttgtaccaacttctctgtggtacatcatatgttgctctgaacaccacattctcaaacatctgcttaaagctgtcctctagtaatttagagctcactctaaatagtcacattatattaaaataagtaattcacatttctcatgtatgctggtaatttttctagtaaatattgcttatattgaagaatcatttactaatctttttgctgttacatgaaaaagtgtttgcacaaacaaggtaaataagtggaaaccaaaatttgcatgtttagtgatttcagaggatatcaaaataaataataatgcatattgataaggtaaccaaaatcattcggcattccttcaattccaatcatagacaaagaaagcttatgctattcatttgtgacattctggattctctccacctttcatgtgcctattcatttttaagttttgctccaggatagccctattgaactgtacaatttctgaggaaagaaagcaatacatgcagcatttcaaatatatccttgctgttaaacccgagatggctagttcgcaactactcactggaacctgacctaggagagttctgtacagcatgcagccaatgggaaggaaaagtctccaccctccaggaccttaagctttagttagtgaagataaaatatactctaagaagcaactatttaccaagtctaaatcttaaagtaagccctgaatcattcatattttagtcccacatccagttaatcacgaagtcttatattctaacttctcatcttcacagccactagtttataatatttccaacagtgctgtcattcgtcccaccagctctggtcttatctcactgtaatactcccttgcagagatttctttcactgtgcaccttaactttgaaaggtatagataaaaaaaataaattattacatacgagtaacagaaaacaacttagataatgagtcagtccacatgcacataacccatctctgaattagtcaatataatatgctcaattacccactttctccacattcttatgtggcatacttactctatgctcttcaaaaaagatttatattttcagggttgaaatatgattatgtcatctccattctcagttagaatattttaaatataccctcaaaattcctaggtaagtccaaattcccttatatggttcttgaagttctggaagtggtgttaccttgctctctggatttagctgtagttattactctccatgtgtgctaaagtatgccatttaaaactatttgtagttatctaactttatattctttcttgccttggggctttggcacatgctgtttcttgcctaaatgtacccacccctttcatgttgcttgtaaattcctccttgtcttccatgaccctagtctaagaactaaagtatctttcttaaatgctcccataaaaccatgtactcatcttatcataacactgatagtactctgttgacattgtcaactccctgtttcagatgtctatgaaacctcaactccctgattacagagactatatttttctcctttctatactgagtggctagtacagtatctcatgcatagaaaatatacgataattatttgttaaattgaaattcacaatttgtggcatagattagatgcatttgtgcctaactaaaaaaaggaggaggtttctctttactaggcattatgctggatattaatgatttcaaagttaatgtgctaaaattcctgtcattccagaacacatcttagtttgttaatttctttctcttccttttttttttttataagtggtcacatttgttattattttttagaaaatacttgggataaccccaaatttgaatccatatctgcattgcaaatatggggtagagttaactggggaaaacttgaattttctcttgaaacaaaattcttatgtatctagtataaataaattgggctgacctaccaaaaagaatacatagcatggaagggaatcaataaacaattgtttgaaataaaaatgactgagtagatttgctggaataaagataatccaagggccaggtaaaagatatgaagtctatggattataagtgggatctgagtcataaaaagagatttggagaactgaagatgttgagtgactgagttttgatcaagtatataatgggttatccaagtagataagcatataatagataatttttctacaagatttataatgagcaattttaaaacatctgggctagagaaatataaattgagaaggttgaaattatagtgaaattttgaaaatacattagaacatctccaacaatgatagaacatttcagagtctaataatttcagtccttaaaattttggttaaatgttcaagctgggatgaataatttggcctttatagtctcgtttaaaagcttcaggagctgcggtggctcaggccagttgtcctggagcataaggaggcgaggctacacattcaaggccaacctgggcaacataaaaacctctcatccattaaaagcttcaaaaattgccacaatctagaacactgtaagattgttatattttctgcatgagagaattttaaaatattatttctgaaatattgtctttatatatttgagagtgatctaaagagttaataacctccaaatctgcatcctcactgaagataaaataaaatgaaatgtgcctttactgaagcagaggagattcgggaaaaattcaatcaaaaccttcccaagttagggatttctactcacatttacttagaacttcaaggaggaaagtttttgaaaatgatataggccttccaatatatagttggaacctttttatgattctattatttaaaaaaatttgctattttaaaaaatgtttgtgggaacatactagatgtatatatttatgaggtacatgagatatttttatacaggcatgtaatgtgaaataagcacatcatggagaatggggtacccatcccctcatgcttttatcctttgagttacaaacaatctaattacattctttaagttatttaaaaatatacaattaagttattgtcactgtagttttttgagaagcctccaaactgctgtccatagtggttgtactaagttacattttcaccagcagtgtacaagagttatcttttctccacaaccttgcaagcatttgttacggcctggcttttggatacaaatcattttaactggggtgagatgatatctcattggagttttgatttgcatttctctgatgattaataatgttgaacaccttttgatactcttgtttgccatttctatttcttcttttgagaaatgtctatgcaaatcttttgcataattttttattagattattagattttttcctataggcttatttgagctccttatatattccggttattcatccttgtcagatgggtagttttcaaacatgttctcacgttctgtggggtgtctcttcactttgttgattgtattctttgctattaagaagctttttaaatcgatgtgattccatttgtccatttttgctttggttgcctatgcttgtagggtattgctcaagaaattttttcccagaccaatggcttggagtttccccaaggttttctggtagtagtttcatagttcgaggtcttggatttaagtctttagttcatctttatttgatttttgtgtatggtgagagccaaatatctagtttcattcttttgcatatagatatccagttttcccagcatcatttattgaagtcttttgccccattgtatgtttctgacatccttgtcaaaagtgagtttactgtgggggtgtggatttgattttgtgttctctattcttttccattggtctatgtgtctgtttttatgccagtaccatgctattcttgttactaaagttgtgtagtaaaatttgaaatcaggtaatgtgattcctacagttttgttctatttgcttaaagtagctttggttattctgggtcttttgtggttccatataaattttaggattgttttttctatttctatgaagaatgtcattgttattttgatagggattgcattaaacctatatattgctttgagtagtatgaatattttaacaatattgattctatcaatccatgaacatgaaatatttttccattattttgtttcctgttcaatttctttcattagtgttgtatagttttcattataaaattatttcactactttggttaaattaattcctaggtatttaattttatttctggctattataaatgggactatgtttttatacttcatgctgttgatatgatagatcatgttgattgatttgtgtatgttgaaccatccttgcatcacagggataaataccacttggtcacgatgaatgatctttctaatgtattgctgaatttggcttactagtattttgttgagcatttttgcatcaatatttatcagaggtagttttctttttttgatacagttttgccaggttttggtatcagggtaataacgttcctcggagaatgaatttgggagcactctctcctcttctattttttggaatggtttgagtagaatttatattagttcttcaaatgtttggtagaattcagcagaattcagatgaagccatctggtcctaggcttttctttatggggagggattttattatggcttagatctcattacttgtcatcagtctgttcagggtttggatttcttcctgtttcaatcttggtaggttgtgtatgtctaggaattcatttatttcttctagattttccagcttattggtatataggtgctcatagtagccactaatgatccttttaatttctgcagtatcagtagtgatgtctccattttcatttctgattttattaatttgtatcttctctcttttttcttagtctggctaaagatttgtcaatttaatttaacttttcaaataacctactttttgtttaattgactttggaattttttttcaattctatttatttctgctacaatatttatcatttattttcttctactaattttgggtttgatttgctcttgcttttctaattctttaagatgcattgttagactatatatttgaggtttttttctctttgttgatgtaggcacttaatagctatcggacttccatcttagcatcgcttttgctgtatcccagaggttttggtatgttgtgttccatcataatttgttttaagaaatatttcaattttcttcttagtttcttcactgacccactggtcattcaggagcatattatttaatttttgtatatttgtatagttttcaaaattcatgttgttattaatttctagttttattccattgtggtcagagaagatacttaatatcatttcagttttttgaatgttttaatccttttttttgtgaacatattgtttatacttgagaataatccaggtgctgagaagaatgtgtattctgcagctcttggatgcaatgttctgtaaatatctattagattcatttggtctatagtgaagattacatctgatgtttctttgttgattttctgtctggaagatctgtccaagatgctgaaaatagggtgtgaagtctccagctattattgtattggggcctatctccttctttagctctgataatatttgctttatacatctgaatgctccagtgttgagcacttatatatttaaaactgttatatcctcttgataaattgatttcttatcattacatagttaccttctttgttctcttacagcttttgtcttgaaatttattttgtctgatgtaagtacagcaacttctgcttttttgttttccattggcatggaatatctttttccatctctttattttctatgtatgtatttgtaggtgaaatgtgtttcttatagacagattaatgagacttgttttttcatccattcagttactctatatcttttgattggagattttagtccaactacctcaatgttattactgaaaagtaaggacttactcctgccattttattattctttttctggttgttctgtggtcctctcttctttctctctttcctgtcttcctctagtgaaggtgatttcctttttgtacttggatattgatatatttctgtaggtttcagaagttgcctgttattattcctttgaataaatttgctccctctatttatttatctacctcttctttaaggccaataattcttagattttcccttatgaaactattttctaaatcctgtaggcatgcttcattttgttattcttttttcttttgccttttctgactaggtattttcaaatagcctgtcttcaagctcactagttcttgcttctgcttaattctgctgttaaaggaacttgatgcattcttcattatgccaactgcattttttaactccagaatttctgcttgattctctttaattattttaatctgtttgtctgatagaattttgaatttcatctctgtgttatcatgaattttctttgagtttcctcaacctacctattttgaattctctgtctgaaagatcacatatctctgtttctccaggatttgtccctggaaacttatttagtgttcatttggtgagattaagttttcctggatggtgttgatgctagcagatgttcttcagtgtctgggcattgaaggattaggtatttattgtagtcttcactgtctgggcttatttgtactcatccttcttgggaaggttttccagatatttgaaaggacttgggtgttgtgatctaagctgtatctgctttaggggggaacccacatccagtaactctgtggttcttgcagactcataaaggcaaccccttgatggtcttgaatgagatctgagagaattctctggattaccaggcaaagactcttgccttcttcctttcttccaaatatatggagtccctgcctctgctctagccacctaatgctgaggactggagtgacacaagcccccttgtggccatcattaatgtaatttcactgggccagatctgaagctagcacagcactgagtctggctgaaggcttgctgtagccactccctgattactgcctatgtttcctgaaagcacttgggctctctaatcagctggtggaaaaaccaaccaggcttatgtccttccattcagggtagcaaggtcccccagacccccagtgggtccagaggtatcatcctggagtctgcccttttttaaattaaaaataagcaatcaagaacagcaacaacaaaaaattgccagagtaaacatcatctttatcttaagcaatgtcagagtggaacttaaaacttagaaactggaacttagaatgccttattgaaagaagaacacacatatggacttaaaatggtaccaacagagagaagaccaggaaaaaaaaattaagttcataaactactctttgcattttgcttttatttaagaattattccttgcttctttcaataaattttgattgtgtgagttttcaattctccagaaattgaaaataacataatgtgctcactattcatgattgcataataaaaccacttgggtattaaaaaaataataattccttagctagaggttactgaatgacaatagaaaaaagaagaaagaatctacataagtggagacagttctcactctaagctgctgaatatgctttctgtttaactaagtaaaaagaagtaatcaaaaaacaatttccacaattttttatgaccatattcacctacctgcctctgtatgtacatactgtgttctctctcttgttctgtagatgagccatccacatggcaagcaaagggcagtctctctactatgtcccagatctcattcattcttgcctagacaagagcaatttttctggaactctctcttttctctcttgcattcttttttttctcatgagcatattaaaatgctgctatttcactctcatttgaaagtaaatatagacatacacgtatgtgtatgcatatatgtgtgcatgtgacttcaccataccctccagttactgtcccatttttttctttatttgttttacagtaaacttctcagaagagttggctatattcattgatttcagtttctttacacttgaacctgtttctatcaggcctttgccaacactactccactgacgtagctgtagttaaagtcaccagtggcatactctttgctaaatcatgagattgatagtcatttaacctatttgggctatcggcagcatttgcatagctgatcactcccttctcctagatactttctttgcttggcttctaggacacaaattcctctgctttccttctccttcactggtctcttctcattctttttcatttattcctactcatctttcatatcttttggagctcagccctttgagattcattcgtaagtaagaacaatctatctcactgctttaatgttcatctagatgctcataacttctaatttgtatattcaagtgactgcagaacagagaagtaatctcaaaatatgcacctccaaacccaaatgcccgctattatttactactttgctataaccttttctatttccactccttattcaataagaagcagctcctttccataaggcagctccttatttttgattgtttgggccacaggccttggagtcacatttactctactttttctctcatctgctgtctaatctgttaataaatcctctaggttatgccttcagaatatttccagaacttttatcctctcactgctgcattgttgcctctgttactaaaatatgagttagaccatgcctctgtggtaatcaaagccttcagtggtttacttttaacccagagaaaaagtcggccatgaaaaacatgtacaatctgcctgctcctcctcctcccactccccactcttcacctgtatgatttctcttaattttcctcctatttacactttcacccagagtcttttcattttctcttccatctgtctgaatgttcttctttcagatatttgtctgtcattccccatttcctgcagatttgagtctccttccctgacaggcctccactaaccacataaaatttctaccttccaatttccttttctcttcctcttctacacttttctccttaccatttaccactatctaacaagcaattttaactttattcactttacaaggagttctgactgttttacccactgacatatccctagcactgagcttgtggcacattttaggtacacaataaatatttattgcatattgccatattagaattactgatgaagacccaggaggctgtctttaaaggaagggattttttaaaatgaaaatgttagaaaaggtttcgaagaacaagttgcatttgaattgaggttagattaaatgataggtaatatttgagtgtgtggatgagggaaaggtacctgtggtggtgattactgagtgtgaaaagccaacgatcctcgaaaataagacatctaccaagaacaccgtctttcaatttgggtggaatttggaaggcttgaaaagaagatatgttcaagttactgggaggtaacttgggatgtataagataagcagaaagcctatttgggtcactgaggttaagcaatgaatttcttccctttcttgagcaaacaggcagatccttgatatgttacatttagatatgtgcagtagctttaatatcttcttccagaattcttccagtgacagtctttctgcttatcaagctggctaagggaaatcaaatcaacaaacctcatttcttattgaggtgggccagatacttattcatgcatatttagggaatataaatctcagttccagaatgttcgaactatagactattctgcataagccagaacataattataaacatgtagaaagaaaccactttactccaaaggtgtataatctatacatattttaatagaatttctcttttatacttgggacctaaatttgagtttagaaaaagcaatcagtaaacttacataatgagatttaagaggaaatagtcaagcaggaaattcctctcccgagcaataatttttctacttctcaatctgcacctctttttttcctgcctgactcaaaatagcaaaattctagccttaattctccaggacccctgaaggcattctcttctaatacggtgttttttccttttggttcatcttccatagctgttttgagatcagaggccttggcttccatcaccgcctggaactgacttccctcaccacttttaaaaatcagagataaatagtgaattataaaaatatgagtaaagtcaaaagcaaacactggaaacatgatcaaatacaacaagaacatcaagtgaagtacttcaaatagcacttcaggtctgtatatgtgattagatgagtttatttttagaataatatattcattgaccgggcatgtgttggcctgtcacatgctatagattattagactgacaataacccctatgacttaaggatattattagtgttagctttcaattctacttatataattattaatgattattactgtaattataaataattatttattgagcacctactatatgttaaccacttaatatgaattatcagatgtaatcttcacaacagccctcttagttaggatatattataatttccatttgacaaatgaaggaagtaaggcaaagtgatgttaagttacctgcccaagatcacaaagcaagaggtgtcagacccagaattcgaaggccatctgatcactacagcctgatttcagagtgtagagttttaactattccacaattctgcttactttcagtaatatacaacttcttcagttattaagaagtaaaagtgagagctagctttaatcaggtgcctatacaccagacaccttgcattatttcctttaatctttgcaacagttctacaaattagaattttataggtgagaaagaggttaatttagttgcccaaggtcgttctctccaaaaataaagttctattttccttaaaaacatattggaagattgtcatgaggtcaataatgttcagcaggcatacttctgcaaaatcataaaactcatcttatttacttagtaaaaccatggctaaattaagaaagagataaataaaggtgcattccattatttttcccactttcaaggtccagctcaaatgctgtattttctaggtctagttccttcattaagccttcctcaattccctgatccccaaaaccaactaatcttatatttcaattcaattaaggagaagcaagtctaatggattgggaacagatgtgcatatttttaaactgctgttgcttactgtggaagtcagacctattaaaccctccattttaaaaacctttaccctttacattctgattattttatggtacatattctgcttagtagtagtgttattgtgttgttcttattctgtcttccaaatgataagcagatgataagcaaagacttttatattcattcattcttatatcttctgtagtgtttaatacagtgcctagcatactgtatatggtcaaaaatggttataatattgatgtcagtggataattcaatgatcccacctttgattagcaattttttaatttaataatctttaaatgcctagaattaatagcaccattctctcagcttctatacccaggataatttctggacacttctgatgactttcccatgatctccggaaataataaaagataagctttacagatgaggtaacagatttgcaaaatattaaatatgccattacctgaagagggcgtaagttgagccctttccttcatctctttcttgctcacagatattacaatatctgtgcaaaaatcctaatgcaagaatgagcttagcatattccagggactgtcattaactgaaatacatatataacaaggaggaaaagatacaataaatgtggaatttattctaattacaatggaaagcaagtggagagttttaagtaataagttttatgctttaaatttttttggctgctgcatggaaaagttccttgaaggagaaaatgtgaatagagagtggtgggaatggcagaggactattgcaagagtccagttggttgctgatgttatcttggactagggttatccgtgtggaaatggtaagacaaggtaatattcagacttgccagtgtactacctgtgggtgtgaatgacaaatgtgagattcaaacccaggtctatattgcactaaagtttacaacatttgcacacctctatattccctcaattgggtatcttgtttactttttaaaaaaagacaatataaaacttataagcctagtttttcttcaggttactttgttgctttctgatttaccattcttatcgccctaaaatctaaatgtaattttagagaatatagttatacattgaaaatataagagcatgcatgggtacatggaaattaagtatcttgagagattatatctattctcaaatttacccttgacaatgcaagcagttacaccaaagagatgaaccaattactgtaaacaagacagaaagcacgtaatctttatcttttttctttgtataaataacttgcagcattccagacgtctctctcattgcaaattgatataaccacaaaaggattttgagtataatttcaaggaacatttgtttgcgatcatgcttcccacctcccaccaaaaataataataaagatcatggctagaactaacgctccaagaggtacttttaaccttaaggaagtgtagactttaaaatctattagtgaggcaaaacaaactttgtttcagctagtgctagagaaatcagacccctaccactagagaactataatgcccattaaaaataaaaattaaacacaaattgtgacattaaaaaatatgagtgcctgggtctcatttccaaaggttctagttcaactggtttgagatgaaactcacgaagcagtatttaaatttttttctcagatgattttaatgtacaaataagattgatgagaacagggcttgaggaaaataaattatgttgtcttttttttataatatcttaggatgggaattcatcctcattttccaagttaaaataactgtcttgctctggcaaaactcagacagaactcatggaaaatacaaagttttcatctgtgtgtgtgtgtgtgtgtgtgtgtgtgtgtgtgcatgcacccagaaacacacatgtaagcacacatgtagcaatggtttaaaagaggacttttagagctctacagtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataagagcattacatagttaggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaatagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattcttatttgtattctcatatttaagagtaaaggccaggcacagtggctcatgcctgtaatcccagcactttgggaggccgaggcgggtggatcacctgaggtcaggagttcaagaccaggctggccaacatggtgaaaccccgtttctactaaaaatataaaaactagccgggtgtggtggtggacacctgcaatcccagctacttgggaggctgaggcaggagaattgcttgaatccaggagacggaggttgcagtgagccaacacagtgccactgcactccagcctcggcaacacagtgagactctgtctcaaataaataaataaataaagaccctaagacaaaaaagaaagataactatctgcagtctagagatgaaaccaccttaacagttttaattatattaggttgcattttcaagtgtcagattgtcccaattcatacagtacttttactagttctcagaatgatctgtatagacagtaccatactgtgtcagttccctggcatgggataggatgtagtgaaaaaaaaatcatggaagagaaaataaattattcaagctccagttactaaattccccagtcacttaaccttttggagaatcaattttaacatcggtaaatgtaaggatcactatgaatgctttacctatctcatagatcagttgggaaagtccaatataagaaacatagatctgaaagtggctaagtgatgtgtaaaataatagtttttctattttgcaatgtataatcatggtgggtctaggattgagtctgacactgtccaaatcaaagttctccacttttctctggattacatcctctgctttttcttctggaaatttggtgtattatgattctcctaaattttcaatttctcaatttctaatggctatttatcatcagcatttaaacataatcctaaatttactgtcttaaaaaagagtctttaataattataatcctttttggctatcagcatctctctcctcccttttagagctaaactttcacaaagttgtctatcccaactttcttcatttttatgttcctttccccttccacctcaagcaatgtgaattccaacataaccatctataaaaacagaaatttctctcaaaaattaccactttctgaaggctacatcttctttaactttttattttacattgtttaccaattccttcttcctgaaacacttttgtgggggataagtgtcttccatgaaactgcattttgctacttttctttctgcctttttatctgtttgtctcggtctttttagaagcctccttctcttctgtttatcccttaaagattgacattcttcagaacttaccataggatcttcatgctcttcacctttactttcctcactattaaaatcacatctatttgcatggttttaatacacagcatgctctttcattcatctcagtttattttctcctggacttcagatgcatgggcatatccaattgcttattggatatcttcactccaatgtttcacatgcaattcggactcatcattgttctccactgcctacctcttgtctctctgtcttaatgaatgacatcataatcttctcagtgactgatgccaaatctgagttttatcttagatttctcccttccctcaacttccacaacaaattaataatgtgtcttgccaatcctacttcttaaatatctctcaaacacatcttcatcttttgatcacatcaccaccattttggtcacaactatgtctcatctaaaatactgaaaatattatccaacctatggtagcacaaaagactgactgcagtgtgtttcatggggatgttttggcatcctcattatattaattatctatcgccatataacaaactgacacaaacttagtgccttaaaacaacacagactcctactttacacttactgtgtatgtaagaattgggtatggtttagctgagttccctgctacaggatctctcacaatgctaaaatctagacgtcttatctcaaaactcacccggggaaggatctacttgtaagatgatgtagttgttggcagaattccttttgggttgatgcactgaggaccttagtttcttgatggctgctagtcagaggaagccctttatatcttgtcatgtgagcccctccataatgcagcgtgcaacatggtggcttgttttatcagaactaacaagggatagagtttgatagcaagcccgaggtcagaatcttatgtaactgattcacaaaaatgacatcccatcatctttgaaatattttattggctagaagcaggttatagaccctgtgcacacacaagaggaagacgctgcacacgaggataaataccaagaggcagaaatcaccggaggccatcttggaattgatctgccagatttcattattcctttctgcttcttaaacttcccacagcagcaaacaatgtaggtaaacattgttgcagtctacacagatgcagttttaaggaaaatccctgaggatgcagaggtaggtaataagaccctctcgtgtacttccttattatcctttatttctccttacatagccctacattgtattataattgttgtctcacatgtatattagatagagaccttggttatcatattcatcacaagtgcccagcacagagtctgctgtatagtaagtgttcaaaaaatatttcttacataaataaccccaactaaataaaatgctatgtggcatttttgctctctgtggtttacattcaaaagattgatagatccctcaaatgaataaccttaataaaacaatactgtctttatcaccactgaatttatctaaatccctctagaattatttatggtttttgcttctatcctccccagggttaatgggtactattccttaataactccatctatttgctctaaaattacctctttcttgactcaagaagatactcaatttctgcattctgatttttcaataattaattctatatttatacttctgtacccatcacaaggttgaacattacaatccaaacacttcctgattaaaatgtttcagccttattcttctgttttcatgtagaaaatgcccaatccctttggtaagttgcctggatcttctccaactgcatatcttctttagggtacaatgatcagcacttcacagttttgtttaaggaaagataaaattcgtaatgctaagttgagatacaaaaataaagatggtgccatttctcctagatctttataataaccttagttgtaaggtaaattagtggctgggctggcatgaagtctgaaatattggtttggatgcattgaatgctaatggaaaaacctgctccaggtagagttttgtgatagagtttatcttctgtgaactttattactcttttgttaacttccatttgtccataatatagtccctccctgaaggttccaaggtgcatcagaccttttttaaagtaccttatgactactaaccaaatgataaaaaactaagttggaaaatgggattggaaccagttacaggggaacatagatcccagctatgccatttgacccagtgctgataataaaaaaagacataataccaaactctgtaatcctgaatgttgaaatcccaaaagattaaattccttaaatctgaaatctataacatctaaaatccagaaaatcaccatctcggaagattaaaatcacaaatattgaaatcctgaaagccaaattctatggaaggcattagtgcattttcagttgcacacaggatagttgcatcatgttagttgcataatgttaggtgggacaataatattaccttgttattgtctttatttggaaattaagtatgatttaaggagacatgtatgggtgccaagttgacaaggagtgaacttgtggacttaattgtctgggtcaacttgactagattaaggaataccaagaaacctggtgaagtattattttgggtgtgtctgtgagagtgtttccagaggagatcagtgtgtgagtctgagcagactaggtagggaagatccgctctaatttgtttcatgcatgttttgcaaatttgattccacgaaagtgaattattacaatgtttactttttgtgtaagcaccatccaactggctgagggcctagagagaacaaatacagaagacaaactgatctctgagagctggggcaaatttttctttagcttcctaggatgtcagaactttgggctcaccggcctttgaactccaggacttacaccagtcctcccaaccaggtcctgaaactttcaatgctgaactgagaattacaccattggctttcttgtttctgaagatttcgaattttgattgaaccatactgctggcatccctgggtcttcatcttgcagacagcctgtagtgagacttctcagcctccataatcacattagccaattactataatgaagtccttctcatgtatctatatatcatcttggttctgtctctctggagaagcctgatgaatactgatttggtatttaggaaatcaaatattattccttcttactgtattttatttcttacaacataatagaagagatttgtgaaattgtttcctcacaaggaagctgtaatacaataaatgcatgaggctactcaatggtgaaacacaaaatttaaaagctaattgttattggtgctgcaaaagcagaaaatcacttagttacaatagctgagcaataaccagcccaaaaatggacagcatatacttacaaaatttgtagaccacaaccacactccaaataccagtgcagcaagtgttttgaagatcccagaagtgaaaattcaggtgaaaaagacaagaaatccctgccaaacaatttaatctgtatgacttccgctcctttacacaaaattgttgttatatatttcattttagcatcattttcaatactggaatttaaaattgtataaataattttaaagagctctaatttgtttcatgcatgttttgcaaatttgattccacgaaagtgaattatcacaatgtttactttttgtgtaagaattttgcatatatgtaaaaacactgaaaacttcttcagtaaatgaaggaaggttcttcttttatatctgcagcttttgtgaaagataagatttctctttgggcaactgcacatgccgtggtgacccatggcagtttttgatggatctcatcaaaactcaggttgcttgtcgtaatatttcacatgaaaatggttacaaactggatgcatgcaattactaaccatagtcatatatgtttatacattttggtttcagacttatgtcatatgaatacagctcattttctcataactgttatatcagtgtgactatcattagtttccctgagtgtttatgcttgtgaaaatgttttattattgcctactttattgtgtaaagtggcccataaagtgttctgtcatgtttttatatgtttcttaagtaaatattcttttaaaaatgagatacattatattttaaggaattaaaaaatttgtttttagaattatgttttccagattttgatctctcaggatttcaacaatcaggattatgccttatggattatggctaaaatctgttttggtttaatcccataggctgtgaggagccattgagagttttggtgcagaggaatcacatgatgaaaactgagcatagaaaggatgaaaaatgcatttagagattgtcactataatttcaggaagaagtaaagaggctgaagaataatgatgatgttgacaatgttttaaaaagtataaatatggccaggcacggtggctcatgcctgtaatgccagcagtgagaccccacctctacaaaaaataaaaagtgcagtggttcatgtctgtagtaccagccactcaggaagctgaggtggtaggattgcttaagcctaggaggttgaggctacagtgagtcatgatcatgcaactgtactccagcctagacaaaagagcaagactctgtcaaaaaaaaaaaaaaaaaaaaaaaaaaagggtacaaaaatgttatagtatgaacgtattgggagaaaggacattcatattggcttacagattttgaacctggataaaaatgtatccttagatagaagtaataagttctagtgtttgatagcacattagagttttgatgagatccatcaaaaactgctgtagttcatcactgcatatgcagttgcccaaagagacaagatcctgagaaatcttatctttcacaaatgctgcagatgtaaaagaacctttcttcatttattaaagaagtttcaatgtttttacatataggcataatgcttacacaaaaagtaaacattgagctaatgcactttcatggaatcaaatttgcaaaacatgcataaagcaaattataactctttaaaattctttacacaattttaaattccagtattgaaaatgatgctaaaatgaagtacataatagcaattttgtgctatgtgtagaggagcagaagtcatacaagattaaattattatttatttatttatttattattttttgagatggagtctttctctgtcacccaggctagagagtgcagtggcgtgatctcggctcactgcaacctctgcctcccaggttcaaacgattctcctgcctcagcttcacgagtagctgggactaaaggcgcacgctaccacacccagctaattttttgtatttttagtagagatggggtttcaccgtgttagccaggacggttttggtctcctgacctcatgatgcaccagcctcggcctcccaaagtgctgggattacaggcatgagccaccacgcctggccaagcttaaattattgaattaagaaattacaacagggaaataatgacagagaaaactagaggaataattagcatattatttaaatctatgcaaataagatttaaagca

SEQ ID NO: 866 - DNA, 79872 bp, Homo sapiens
acagaatttgtagattcttatccaatgctccaaactaatggttttactgcaagaagccagcctttatttaatctttggagcacagtgataataacactggttctggaggcaggttctgttatgtatagctctatacttttggaaagggcatttaagacagttttcctcattaaaaaaagcatcagtgataataatattatttatctttgatgcctttttttgggatggagtctcattctattgcccagactgactggagtgcagtggcacaatcttggctcactgcagcctctgcctcccgggttcaagtgattctcctgcctcaaccacctgagtagctgggactacaggcatgtgccacctcgcctggctaatttttgtatttttagtagggacaggatttcaccatgttgtccaggctggtctcgaactcctgacctcaggtgatccgcccacctcagcttcccaaagtgctgacattacaggcgtgagccaccatgcccagcttctttgatgcttttaaatgcatgtataaagtgctttgcatgtgttatgatgttaaccattatgtctagtgggtttctttaactcttgtttttgcattgcaggtaaacatctgtactctctgtctgtctgtctctctctctctctctctctctctctgcctccctctgtagagacagagagtacataagtatatatagactatatagacagattatatatatagagagagtgtacatacagagaatacatacatatatacatatatatgtatatatgtataaagtgctttgcatgtattataatgttaaccattatttccagtggatttctttaactcttctttttgcactacaggtaaatgtctgtactctctgactctgtctctctgtctctttctctctctgtaaagacagagagtacataaatatatgactctatatagagagtatatatatatatatatatagagagagagagagagaggaactacagagaatacatacatatatagagatgattagataatactctatattagataatagactattagatatgactaataagattaaaacctctaatattagtgcaaatttagtacaaatgtccataatttcttctagtaatcaattacttggcttttttgtctctcagtagctttatacttatataaataatacaaatttttactatttatttttctacacattaatagattcatttttatatgtactcctttataattcacattattgtctaatttttgaatgaatgtcattgtatcttatctgacaggcatacaaatgtaaattttgagggtatatgataatatttattttatgaatactggtgatgatgatgggcatgatagtgacaattatgatgcaacggtgatgatgatgtaaaaagtaatgatgatagggatagaagaaattggagttgcaatgctagttaatattaattttttcatatgttgagttccagaaaataaaatcaagtgcttttataaattagcttaatcttctcagaaattccatgcagtaactaagatttattttttaaaatttagctttagagatattaagaaatatgcccaaaataacttatagcaggcagagctttgattctaattgagactgcctgactccagagccaagtaggctaatgacagcatgtttagttttcattttttttttcaaatgtcaagaaacatgtttaattaaattgagtcaataaagcagaattccctgtagaattctctcatgccaaattgggctcaggccattggtttgaacatgttttaaaatcacctagaataatatcgaggtatatttttgtgaaacatcttgttttgttataaagaacctcttctttaaatgcatgaaataatgactatacattattgttagactttttcttccatttaatttactataatatcccattacctcagctttcacttttcttgctgaacatacatacagcatactttggttaataataagcataattttaaaatagaatttcagaatacttgttgtaaaaggtgacagggactgaaagaagaacaagcatcaacaggaataaaatttaaaacatattttttggaaatgaaattttaggaatgattgataagtgtttctttaatttctcaaagccctagtttcctcatttgtaaaatgattataataatatatgtctcatttaataattgtgagggcaaaagttacataattgttgttaagggctgaattgtcttgccctaaacttcatatgttgaagtggtaacccctagtacctgagaatgtgtctgacattctggacaattaactttaaagagttagttaagttaacattaagctatttgtatggttctaaaacaatcgatttgtccttatttttgaaagagaattttgatataaaaggggacaacagagacacacgggagcagtgagataagcgtgcgaagagtaaccaagtgagcagccatctgcaagccaaagagaaaggcctggagcagagcatcccatttttgtcctgctgacatcctgatcttggacttccagactccagaactgtgagaaaataaatgtctgcggtttaagctacaaatctatgatattttgttatgttagccttatcatatgaatatgatagtatgtaagtatatactatagacaccacgtgtgtctaattatgttcttctgtcagccattagtgtgacaggttaagtccacccaatactttgtggagttgcttttggaaattgttactacagcttccttcagaccatcacaaatttccaggatcctccagaaatagaatgctgtaacgttgtgcttaatgttacttctagtttgcccaagaatttttctcagcattcctgctccaccagttttcagcaggacctctgtgcccaaatcacagaaggttctctctgcaatcttgctcctcctcattggcagttcactgttatattttatatgtgaaaaaatcatgatagaaaccgttggtagttcccggttctcccggtctggacttattctaaatcagaccctgttcaccaggccctgtgtacctggctcttctccctaattcaaccaaactctttattgcgtgtgtggagggtctcagaagagagaacattttctatccttccctcagtcatagcagtattggttggtatcagtacagcattctgggtccaagcttctctctcaggggcagatagattttcctgctctctaggtggcaatatacctttgcatgggaccaggatcagaaggatttgttggtcttcccacaaaagtagactacactgagcatacagctcgtgggattttctttccctctcttttttccttccccagcaacagatgacttgcttcgaccccttcccctctgaacaatggatctttgcctgccttctattcccaagttgcttgaggcttttaattcatataataaaagagctcaagacataggcaaggttttgtgcccacactctttttccttccctgcctctaatcttcctcatgagtatatagtggaggcttatgaaaagtacatggcaaatgaatgcacactttcactgggtctggagttctcaaaggttctaaatcgtcatgctagcccacaatcaacttctaataaagtactgaaatgtaattgtttcctctttcctgcttgtacagtgtttttgtcccatgttttgccaaaggtgaaacattcgtctgttctctctctcctcagaatggcctgccattctggaatttagtccacctgattgccttgagatctgagctctgatatgtcaaaaaatgtgataattttgaagattatctggccttttcttcttgccaattaaggtgggagtgatattctcttgtaggacatcataaatagaagcacaactctctactgacaatcctttgagaagactccaaatatgaatacctgaatatgctgagactgtagaatgcaagagtataaaaaagcaaaaatgtactttttatcagtaaatccaataaatatatttcataagaatgatatcttccacttacaatgtatgtatatattatctaagtatccctagtgattatatgtagaggtcatttaaaagttaagaatgctcaaagaggttttggaactaattatatttcatctagaattatgtatttcacagttatacttcaaaataaaatcatcatggtagaaattgagtgattttgcattatgaggagacatcagacaatcaagacttgtttgtttgttttcgtttttgaggtggagtctcagtctttttttattgttgttgttgttgttgttgctgttgtttgagatggagctcaggctggagtgcagtggcacgattttggcttactgcagcacctgcctcctaggttccagccgttcttctgcctcagcctccgattagctgcgattataggcatgcaccaccatgcccagctaatttttgtatttttagtagagatggggtttcaccatgttggccagactggtcttgaactcctgacctcaggtgatccacccaccttggcctcccaaagtgctgggattacaggtgtgagccaccatgcccagccaagacttgtctttttgaagtaagaataatttacctaacccccagagtatctccaatacattctgaaatttatcagatagccagccacaagagagatacaacattatatatccaaaattaaaaataaaaagtaggataaacttcattattagacaattagaagtatatgcccagaacatacatttgtaaaactacgctataaaagtaatagaattcaacaggctgaatgttagatctataaacctagggtatccattcactagagaatgaaacaataagaatagtaatcaatgcctcaagagaaagctcaatatttctaacagaagaaatcctgcatatataacaaagggttactagtggcttgagaaactccaggaagcctatatagagaatgttttatcaacctccccactgcgaatgttcctgtggaagaggaagcacaggaaagtactgcatcttttaaaatcttgaagcagggactgaatatttactctcagggggtggtacacttgcaataagtattttgttatattaccaaaagaaaacaatctgaggtacaaatggtaagaaaatgttagattattcagaaagctctaaattctggaattttttgttaaagcttctgaatatctgcacatctactaatataattttagtaatatgtgtgtaattacaaacctgcaaatttgttgatattaccatgccaataaatgtttccaactcagcatttcttaaaatatggataggagaatagaaaatttatattcctccaacttctttaccactttatgaattttagtaagatagaaagcagcctaccctgaacacattttaggaaaacccagcttttcttctgtattctgacaagggaaaaacctacgaaagtaaaaaaggctaccgtctctcttgctcgaggataccacttacatttagttcaatcacaagaacagataataaagggtaaattgcaataggcaatttgccactttcctatgattaacaatcattacattgctcattgctgtgccactgtgtctgtgtatataattgtgtaaatgtttttttctgcttatccatggaatatatctagacaatttgaaatctactacctgcttgttcactactcctattgcagctaatctcttgaatgttaaatttaacctgtctatttaaagtcatgatacttgataataagtactacatttatgaagcacttattacatgctagtcatttggtgtacattatccactttaattattaccacagctttgagatgcatgaaatattatgatctttattttatagattagtaaaatgaggtttacagtgtttgtgtcatgtccaatttcacctagctaagtaatagatagaagaaaaatctgatctgatatgtacctgattactatgtatcttttcctacctcttgcactgtaccgtctcatccctccagcaagaatgacttcaaaagtttacttttgtctatttaacttggataccaataactatttcttgactttgaactacataggaattttttttttttagaggaattttgctcttttgctcatgctggagtgcagtggcacgatctggggtcactgcaacctctgccttccagtttcaagtgattctcctgcctcacctctgagtagctgggactacaggcgcccaccgacatgcccagctaatttttgtatttttagtagagacagggtttcaccatgttggctgggctggtttcgaactcctgaccttgtgatccacctgcctcggcctcccaaagtgccgggattacaggcatgagccaccacgcctggctgcataggactcttaatagtctcggacagtggctcatttctctaactattgcaaaattgagttttacaatccatcactctatatttctcaaccaaacatcttctctttagtaccatcttgtagtcctccaccatcagctgctagttattccatatagctgagtcatttaaaaaaacacagacgagaaactgaaaccacacagtcatattgacacatgatgggcctttttggataaatacaatatggcctcaagtccagattgattccaagcattaattaagtgcttatgacaagaatgtgtttgaaaagaatggattttatttggtacatgtagttttaataactacacttctatatttcaagccctaggcactatagctgcattcctctgagaattttcctcatcagaaacattgtggaattaggtactatatgacatctggtgtaaaatcaaagtatttctgagaaggtaaaatgtgatattattcaactcaacttgaaacattttaaaaatactcctatagccctggaaactttgttcactaggccattgaatgcatgctattttgacgtaatgtcactgaagagacaggagtttgattctacactgaaacgtcaactcaaatttcaatcattgttataaatttgtgcaatttatttgcattttttttctaaatttcaggaagtgctaaaagcaaatggggcaaaattatgtagtaaatccacaagttttgtgctctcctaactgcattgtgcattgtagcaataaaaaatatttaaagagaaaaccaaaagaacaaacaataccctagaaaaagataaactttttaaaaagctgaaaattgaatataaaatacaaagaagctaagacaatgaagttaaagattgccgaatgtcaggtttgggagaacactgtagcagactgaggttcagtttcagaggattaacacggaccaaaagtgttcctatgcctggagtttaatttagattcattgcttaaagaaagaaactaagaacaaatgctgctgatggctacctgtggcaaggactcataggatcgtgtgggctgaagagatgggaaaatataaacacagcctcacagaagaaataaactaagtttgaatctgtaactggctggatccacaatatccacaaagcagaaaagccaaaatgagagacctgattccagatgctgattctactggaacatgttcaaacaagcctctatatagaagatcacatggaaggacggagggagataagagaaaaaagaaaggaaacagagagagagaaagagagggatccttttcaatcaaatgagtctgcaaacacaaatcctgaattgcctgaagaaagatgcacacaaacaaaaatcaacaattagaacattaattcattccatatgaaattgattataaatgtttcataaacatattaaatatatttaagttgctttaaaggataaattaagatttggcattgataaacaatttttaaaaagaaataaaaaaaacagagaaaatgtgtataaaatagtacaggtgcatatgaaaagaacctactagaaatcctggggaaaatatagtcattataataaaaactctgttagaataatggcccccaatgaatcacaaccttcttattttacattcttttatagtatgagtttcccatttcttcacctctttaattcagcatggctttgagatttgcatagactgacagaatatgacaagaatgatattatgtgactttttatgctaggccttaagagaccttgaacttccgccttttctgtcttggaatgaatcttttgtctcgtgaataagcaactctgggctcctatgagatgagaggccacatagaagagaagtaaaaagctacagacaagagccaacaccaaccaccagacatataattgaggttaccctgaaataaacaccccagttaaggttcagataactgaagccatatatgagtaatcctaggcaagatcagcataagaactacttagataagctcaacacaagttaaataaatatatacttgttttcagacactaaatttggaatgatttgttacacagaaattaataattaatacaaacattggcaactagaaacaaggtgctgccataacaaaatcctaaaagctaggcattggctttgggaccatgtagtaggtggtctatagaaattgctatttatgtctgaaaatgtggggatcaaaactattggcaaaacttaagacttaaatagattaaaaaaatgtatgcaatgaatgtgtagatatagccaaggtgatatcccgacagaacaatgaaattgacagttggctttttgtatctgtctataataaataggagaggaggagatgaaccaaagggagtatgattcatttggaaagcagaatttagaggaaatataaaggttcaagatgtgctgggttagaaaataaaatcatttcatatttctagactttctagctgtggtcttagaataaaaatcaaaccaagtgtgtggtgataaaacctttagttaagcacacagagaaatttatgatagtgatcagtaaatccttgcaattaggcaaagaacttctatgagtttcaagggtattatctcacaaacaccttacaaatggcccaatgtaagtagaggtttatttgttaaatagttatggatgtggcttttgaacacggagggaatctcaattagattcacaaaaaattcaaaatatttaaggtagttataatgtctcatccataggaaatagagacagtttataatgaaaagaagactctgggaccccaaatctctgtggtcaggaagcagactgggaatcccctttagttgcaaacacagtccatttattatagaaaatgaaacaaatcttagagcgtggagaccagttacctggaaggcaaagtcaagaactaaggagatcaatagttaggaaactattcagccgaggaataattgggcccttactaggatgtgttttcttactatggagaagaagactcttacaacgtatacatgtctatatttcagaatttgtaagaaccagtgacttctatatgcctaattccatttcttctctctttttttttaattggaagtgtctattgcaattattctttccctgtcttatcagcacatgttgggtatattgggtgttgataatttattatttgttatttacagttttattgaggtatacataaaaataaaaattgtgtatatttatggtgtatagcataatgttttgatatatacactgtgaaatgattatcaaaatcaagctaattaatatatgcatcagctgacatagttatgctttgtttcattgtgtttttttttttctggtgaaaacacttaagatcaattctcttagcaaatttaagtataaatacagaattgttaactatggtctccatgctgtacattagagctctagaactcattcatcccacataaccgaacttttgtaccctctgactgatattttatttccttccattctacccttgtcaacaggagttctggagggaacaaatattcagaccatagcaaaaggcatagaatataagaatgtaattgtgcacagaaattaataaaacatatttattgcttgatagtctacgtcctatatgcttgatagtctacatcctactcaggaatgcctgtagctagtgaccaattattattgcaatacaaaactcagctcctttgcttcaagtcacgatacacttagaagtataatttatgctccagagtttctcaaatgattaagcattcttggatgccaccaaaattgtatcttttctgggcttcttacctacccttccttttcctgcttccctcactcttacttgtttcttctggtagtacttgctcagtaaataacttgcacctaaatctttgactcatcatctacatctgtaagaacctgtcctaaaataaacatattagtttaagaaataactggaatttttactgacgcctagaatgtggaaacttggaaagagtattactcctacattaataacagtaaaatgtcagtttaaattttaaaaattataacttttcttgaatctgtcagagaactaaggtcttggggaaaccaattagcttggaattcaaggaaagtcaggtgtctccaagcagatgagatagacacactgaaacacatatggcagagaacaggaggaaaatacatcactgtcttgtaagtggttaaaaagaatttatcaatttttttttttcgagacagagtctcgctctgtcgcccaggctggagtgcagtggcgcgatctcggctcactgcaaactccgcctcccgggttcacgccattctcctgcctcagcctccggagtagctaggactacaggcgcccgccaccaggcccggctaattttttgtatttttagtagagacggggtttcaccatattagccaggatggtctcgatctcctgacctcgtgatccgcccgcctcggcctcccagaatgctgggattacaggcgggagccaccgtgcccggcagaatttatcaattttttttatctgaaaaagctcaagtatgggctagcataagagtatagaaccgctgggaggcatggatatcaggggtcttcataatacttgcaggctattctccacagacttctaatgggagcatgattggatacagaaatcctctaacagtggtgcagacttggataaggagagcattcatcgctacacaaacaagcataaatccccatgtaagaccttctcctctatggaacaaaagccttaaattgctggggtaagggcagcacaaaccatcacccccagggcacagatgaagatgaagctagggaaggtacaagaaaaaaacaaaatatctatccctgaggtaggggtaggaaactgtcctggaccaagttcattatatgtctcctaccactaggggaggggcagggaagtctcccatacaagacctagtaaagattcacagcaaaatttggcttctatcggcagatttactaagaaaatatcaacattaagaccaagcttgcctaagttttgaaatggtacaaaaataagaaaaaaatccttttgccccctaacaccaagatcacgaacaccaagtaataagcactaacagtctactactggagagaataagaacatgacaagatccgttgtcaggtgcaagagcaaaagggaaggccaaatgttgagggtagataagggacattaagaaaaacactctggtaatctgattttcaccctacggtattgctaaaagaattttaaactggttgtacactgaaggtaaccatagtaacagcaaaatcccaaatcagctaaactcatgactaggttgactccagtctccacataaacacactggcagaagagatgtgcatctttctttcatttttctttatctttttctttttcttttttctttttctttttcttttttttttttgagacagggtcttgttctattgcctaggctggagtgcagtagcatgatctcagctcactgcagcctcaacctcctgggctcaaacaatcttctcactttagcctcccaagaagctgggactacaggtgtataccaacatgcctggctaatttttgtattttttgtagagacgagattttgccatgttgcccagtctggtgttgaactcctgggctcaagggatccacctgctttgacttccccaaacagtgggattataggcgtgagccatagtgcctggctgcgatgtgcatatttctatgcaaaaatgctatttacttcagtctcgactgtacttttccttcatgtctaggattcagtattaaaacagaaaaaaataaggaaaaaataacccacttagaaaaagcaatcatatcaattagagtcagaaaagaccccgatgttaaaattatcagggaataaatttaaaactatgactaacagtttaaaagttttaaagcatagtttcctcatcttcaaaataattttttaaagtgtcaagtgtcaaattcttatggttattgtgcatattaaatcacataatgttagtgaagtgcatacttaacaaaatatctgacacagggtaaggatttagtaaatgacagtagttgtagtcattattacctgcaatacttaataaaatatggttgactgtccaaatgtgtttgtgataaacttggtttgaataattcctattaattatgcctttctagaaacttttgcaacaataaaataaatgctgcaagggctgattggttttatttcagatgttcctaagcatatctttaagccttaccctacccactccaagctgatttccatcactccccacctccttgctccttgcttcctttgccttaactatattttttgttgttgttattgttgttgttgtttaatcaggactaggagatgaaaggcagctgaacttcgttttcctctgtgatagaaactttgatattggtaactatttcagctctctattcaagaacactggaaagtttctggtcacaaaaaaatgtcagtgacttcactgtagtctgtaccttttttcttattgtagaactcaaaattctaattttccacttattattttatttatctctatcataaagccaaatattccaattaacaccacatagtaatttaaagtactattggaatatactttaaaattattcctatttcccttgaattttgtattgtttatgtaagtaaaattcaattataagtccatattcatatactaatcagtgatatccagttgtaatgataaatgttgtttctaaaactcttttatcattcaaggggcagaaactggattacagaatccatctcctttacccaacttttcagagttttcagctcccttttatttttatgtatcttgagttatttcttctgatagattctgtgccttgaaataatcttcaactaataaaatatttagaatttaggcaatagaatgtgtctatctgtttcaatcatagactctcctctccttgtaaccagactatatttatagtatgaatattattggccagctacccataaccaacacagatttttagtatatctaataccatcatggttgctgtagttctttcaaaatgatgtatcaaaattaaagttaatgacaagtacaatgtaaaagtaaggctgcaaggtatctctgtatttagctgccctgtgttgggatatctactattggaatcttgacagcaaattttactgctcattgaagattattccacatgcacttaagtttctctagctaattcattatagttcctcattaaattataattacttttaaaaataataattattttaagaaggtgaatccaagagctgttgatatcatgtggcttattttccccatttggtgaatgtattagttcgttttcatgctactgataaagacatactcaaagctgggaacaaaaagaagtttcattggacttacagttccacatggctggggagacctcagagtcatggtgggaggcaaaaggtacttcttacatggtgtcagcaagagaaaatgaggaagaagcaaaagcgaaaacccctgatgaacccatcagatttcgtgagacttattcactatcatgagaatagtgcaggaaagactggcccccatgattcaattacctccccctaggtccctcccacaacacatgggaattctggaagacacaattcagttgcgatttgaatgggaacacagacaaaccatatcattccaccccagcccctccaaatcacatgtcctcacatttcaaaaccaatcatgccttcccaacagtcccccaaagtcttaactcatttcagaattaacccaaaagtccacagtctgaagtctaatctgagacaaggcaagccccttcaacctatgagcctgtaaaatcaaaacaagctagttacttcctacatacaataggggtacaggtattgggcaaatacagccattccatatgggagaaattggccaaaacaaaggggttacagggcccatgcaagtccgaaatccagtggggcaaattttaaagcatcaaaataatctcctttgactctaggtctcacatccaggtcatgctgatgcaacaggtgcattcccatagtcttgggctgctctgctcctgtggctttttcaggatatagcctcccacccagctgctttaatgggctggtgttgagtgcctgtggcttttccaggttaacagtgcaagctgtttgtggggtctggagggtggtggccctcttctcacagctccactagtccagtagggtatctgtgtgggagctccaaccccatatttcccttccatactgccctagtagaggttctccatgagtgctccacccctgcagcacacttctgcctgtgtgtccaggtgtttccatacatcttctgaaacctaggcagaagttcccaaacctcaattcttgacttctgtgcatccacaggatcaacaccacgtggaacatgtcaaggcttggggcttccaccctcttaaacccaagctgtacgttcgttggcccctttcagccacagctggagtggctgggacacaaggcaccaagttcctaggctgcacacagcacagggaccttgggcccagcccacaaaaccactttttcctcctgggcctctgggcctgtgatggaaggggctgccatgatggtctctgacatggtctggagacattttccccatggtcttggggattaacattaggctccttgccacttatgcaaatttctgcatctggcttgaatttctcctcaaaaaatgagtttttttttttctactgcatcatcattctggaaattttctgaacttttatgctcagtttcccttttttttttttttgagatgaagtcttgctctgttgcccaggctgcagtgcagtgacatgatcttggctcactgtaacctccacctcccaggtttaagcgattctcctgcctcagcctccgaagtggctgggactataggcacgtgccaccacacctagctaattttttgtatttttagtagagacggggtttcaccatgttagccaggatgatctcgatcttctaacctcatggtctgcccgccttggcgtcccaaatgctgggattacaggcatgagctgcgactggccccatttccattttaaaattgaatgcttttaacagtacccaagtaacctcttgaatgctttgctgcttagaaatttcttccaccagataccctaaatcatctgtctcaagttcaatgttccacaaatctctagagtaggggcagaatgctgccagtctctttgttaaaacagtaagagtcacctttgctccagttcccaacaagttcctcatctccatctgacaccacctcaatctggaccttatttttcatatctctatcagcatttttgtcaaagccattcaacaaatctctaggaggttccaaactttcccacattttcttgtcttcttctgagccctcaaaaatgttctaacctctgccagttactcagttccaaagtcgcttccccattttcaggtatcttttcagcaacaccccacactactggtactaatttactgtattagttcattttcatgctgttgataaagacatacccgaaactgggaacaaaaagaggtttcattagacttacagttccacatggctggggaggcctcagaataatggcaagaggcaaaaggcacttcttacatggcagcagcaagagaaaatgaggaagaagcaaaagcagaaacccccataaacccatcagatctcatgagacttattaactatcatgagaatagcatgggaaagaccgaccgtcatgattcaattacctccccctaggtcccgcccacaacatgtgggaattctgggagatataattaggttgagatttgaatgggaacacagccaaaccatatcagtgagcccccacatcagtggcaaagttaggattgcaagcccaggtcatgtgactccagagtccattctcttaactactctgctatgctgtctcttacaatactttctaggccgtctaactgccactaattgtatgacctttggaaagacccttaaattatcaggaccactgctttcacatatgagaaatggggataataataaaaattattacagtgctgttttgagcattaaatgagttaatgtttgaaagcacttataagtgtttgacacactataagcactgtaaaggtgttggctaaaatgagttcttttaaatattaccttacaattatcttattggtatcagttaacgtttttataagtagattaaaagtttgtacaatttataattaaataaaagaataattgttagtccgtggctggaataagttaggactttgacattaaaaccccttatagttgtgtaattacttgcctgacaatactgagtaagcatgtggctactcaaatcctttataaaagaaattctcgtaatttagtgatattacttatgataggtagcattcactaggaatttagtatgcttcacaagctattcctaatactaaagtattaattctaattaccagaataattccatggaataggtactactattatcaccattttagagataagaaaaataaagcacagagaagtagctccaaattcatagagtaactggtagagatgagacggaagaatttatcatgtcctaagcacttccaatttagccagttttccactcttttcttctcccagcatcgtaaaatctgactgataagtataaataaggaagaaaaaataacatttattctctacaatatagtctcctcactacctgatgctaaatatgaagggacagttctaatgaaagtgatcaacaagttctagaaggaactaaagcttagttccttcctcaacctcagtgaaaagaacaaggttattagtggcgatgtttttcctaggtgtgggggagctaagcattttgaacacagcaaagataaggaagtcggtctgtaatctgcaaaaaggtaagacatttattaaagcattaatcttacctagactggcttggattttcacagtgatctcttgctcatcatgcattttaacaccccttgccacacaaccacttctaaattcttcctctaaaggtaaagagctgtatgttctgagagtaaggaggaaattcctaaaaaagtatctagaatctagaaaattattctctaggtttatgcctcatacatgattgcaaaccatagtgatgatgagcatgtttgtagaactgactttaatggtcttctacaacaattcaggctacatctgcccagagagtgtgtgtggtccacatgttctttcaaatggagaggacctaatcattaagacatagcttttttttttttttcttaactttcaggagtcagatgtggaggatatagagagaattttgacttttagtccatgttgttttccctgacacattttcaattacattgacaactaaaaaacaagaccttggcaagaacatcagggagaaatggtgatgagatgaaaagatgctcagataggcagattttgatatatgactggtcaacagaccttgggaggctctctctacaatgagaacagaagcatccttgtgctaaaggctcatctgcttacaacggttgagataaagaggaatttctcgagctagtggaagaaacaggatgagaagtgtgaaaggaaattaaattttgggattcaaaactcatttagccaaagggaaaagtcaagctgtgaactggatcatgcaaacctgcctccacctttcagttcctaaataaaatggctacaagatgcaaagctactcacctttcccatattttgccaacaaggaaattcctgatgagctgttaaaacttcaccatggcaatgctaattgatagcttatctttataggtgcagtcactcagcctgccagacacaaatgcatatcagattgttcccctaccccattttatttgtgtaatgtaaaatgcagatttcccacatttttcctttgccccttttaagtgaaaactgtgtgcttctcaatatcctgccctttcccctttaaatttggagccctcaaaatcatcttaagagaaaggcatagacctgactcctgggcgtgtccttaactttggcaaataaatctccaaaaatgattaagacttgtcttgtcattttcttcgattcacagaaggcaggatatacaagtagaaagcagaaggcaggatgtacaagacatcactctaaaacctttgaatcaacaaatgaatagcagaaaagcagatgccttgacattgtccttttaaatacacggactcaacaaatatcattgccagctcctaatatgttaggccttgctgatacattggttgactagaaagagtttcctgtcccaatggagctgatattgcagaaaaaagtaaattgtacaattaattacaaatgtgttgaatgctttgaagaagtatagatcattttgagagcctccataatggaaaatttaacctagcttagtcaaacaacacagaaaaaggcatttaatctaaggcttcaagcatgggtagacttcagcttttcaatgtgggcaaaccgatatagagaattcaggcagtgacaaaaaaaaaaaaaaagtagccttaatgtctcactcacaaagctaaatttatggttgaaaatgttaatctatcttctctcatccagaaccaaataaggattgaaaatgtatattttcagaaggattatgttaatgaatatttattgcatgctcttcctgtgccaccaaaacgctaaactctttatattcaacacattatttaatccaagcagtagcctatgtggaatgtgctatcattccttccattttacacatgaggaaactaaacatcaaagcatttacactgtatatatatgataaatccaggaattcaaataaaggtctccctagcacacataccaaactccttccacaatgcttttccacatttattagaagaaaacaggaacaaaaaaagcagtactcaataaaagcaaaataagttaccctggtgaaaaggaatgctgggaggaatgcttttggctatttataatcatacctacatcctcaaaaatccattgccagagtctatttccctgtttaacaatttgtgaggatccttagagaatcaacagcaggaggcaccactgttcagcccattagatatgatccaagatttgtctcagtgcctgactcttctgttctctagtaaggggtctatcaaaacccaatgtacttcatttttagcagaaaggacacatttcccaggggaaattgaaggtgatccttctcaaagtacaaatctagctgttttttgagatgcgatatatcgatgtctggatgaccatattgtgcaagacaattctcttcaggcccaaagttcttttcatatttacaataaaggaatgctatacagaaaaattttcacaaagatcaaaacaattcaaatagattatgccacacaatttcagtgaaaagaaagcttcaacatttacccaaagcatcatcagaaaaccacacttgctagaagacttaatgtctctcatatcacccacagagacatgagtgagtgatcattcccagaacgtgctattcaaagaaaatccattcatcttgttactagttgtcaacttcatgttttaaatctcatttcaatcacacaagaataagacattttctacacctcttagtcaatgaaagagaaatcaatacatgctttttaaaccaaaaatttatatcttcattactgagagaagtcaaaaacagaattatcttaacagtaatagtggtatataacacctctcctttttatttgtttgtgattcttttgttttcttacatagcatataaacagcttagtttatttttccttctactaagtcttcataatcatctcccttagactgagttccaaactctttggaaactactgatgcgttaattggctttttaaattatcttaaaaatataaactttattaattaccacatatgttctttcttttaaatattaatgacttggccaggtgccgtggctcacacctgtaatcccagcaatttgggaggccgaagggggtggatcacgaggtcaggaggtcgagatcagtcaagccaacatagttaaacccatctgtactaaaaatacaaaaaattagccggttatggtggtatacacctgtaatcccagctatttgggaggctgaggcaggaggatcgcatgaacctgggaagcagaggttgcagtgagcagagatcacgccattgcactccagcctgggtgacagtgtgagactctgtctcaaaaaaaaaaaaaaaaaaaaaaaaaatatatatatatatatatgtgactcttcatcaagtagtttctatgaataaaatcagatttcacaaactctgtaaagtgggagaatgaaaatctagtaggttttacttatctgccacaactaaaaattagtatagatttgaggaaatgtcattttgttttgaagagtgtgatttaaaaaaaaatatatatatataatatatatatatataatcttaatttgctttgtcactcatataaaggaaaccgtagttgagttgtagacaatgaggaaacacttgaggcttccgctgtatgtttctttgttattgttatgttgttacccagtaacttgaatattgtttaaagtgttgtaagacattgtagagtttatctcaagctgttaaaaatggtaatgtacaaatgtgaatagacacttatctatataatatgggtaagttttgttttgcctataatagatgtttataaaacaagtgagggagcagttggtatttttatttccttttctttctttctttttattgaaaaatcaagattgtataaaccaaaagctgcaagatgccaaaatcttgtagatgtcaaataaaaagttattttactaaaaaaaaagtgtgcgttggtaatcactactattaataattttaaaaaggataaataaggtcatataaccctgtctctggttcagcaatttggaaaagttgtagttagaacaggagactgttctaatagagagagtgaagagtacaatatgtagtttagttctctcatttggtaggtgcagacacagaaggaatgaaaggctgcatttacacgattagctagatctgtacaaacatttagtactttaacttttctcaaagccttttatgtattatcctatgggtaatgttatcccaaatgtatggataaaattaaaacaagaacactaaatgacttcacaaagacctgaaaggcagatcaacggcataactaatattaaaactcaggactagtgctctgaacatcaaacctcctggatgaggtcttccgtggcacatctctcatttgttgaacagtttttaaaatactgtgtgctgggctttaggttgagagataggacacgtgatttatcccttcagggtgtttgcatcataaagaggcctgtgatcttcaattaatcatgtggccaaagttatttctaggggtcagggagtcattgacaattcattatgccaaatgtgccaaaatgccgaaaaaaaaaaaaccaaaaaccaataatgtaagtctcctgaatataaaattttcaaaaactgaattagaaacatttttttttactctagcaagagcaattcaataaaagcagacatataaaggataattttttaaatctgtgaccaaaattgaatatgagattgattcatctacaaagtgtcttacttttctgtagtacaataaaataaattatactgtcctagacaggcaaacttcaatataagggagatttaatgtcgtctgtcctatcatagtgaaatttgactccactattagtttctgaatactttcatgatttccctcctgctagtttaccatgagacaccatctcagacttctacacagctcatttgcacccatcacaatatataaataaacaggagtgtgccttttctctgccgtatttccactcaactaattcctgtatctttcagctccaccagttctttgtatacttgcaaataatggctgaaaatatttatattttttcttgacttcatatttcttctacacactattagttttcttactctgtaatttaagtgacagatttggagtgggacaaatctgtatgaaaacttataaattaaatttcccatttaatgagaagattttaagtagaggttaattggtaaattactttctcccttttcccccatgctcttttcatattctgattgcattatatgtatgtatatttctagttatgtgtacaactatacaaaatttgggaatataaattcatttcattaacacctgtaccctttttgctcctactcaactcttttttgcacgcaattcagcaaaacttttggaaatagttgtccatattcactggcttctctttctcattttttcacctctcacacaatcctttggaataaggttttcatcttcataattccacagaaacggggaacactcatgttgccaaattcaatagctacctctctaacctcttcttattccatctcttagcacacaacacagttgaccagttgctcatgccctgtttctttaaaaactcctttttcttggcttttttgaaccacacttgtctgtgacagccaccactccttgacagctgtgctgtctccatttgacctctaaatgttaggactgatttgtgttaatagaattataggttacggagatggagccctcacaaattggattagtgtccttataagggccaaggaaaccagagctcttcccctcaactatgtgaggacagagtgagaaggttccttctgagtcatatagtgggtgttcaccagataccagttttgctggtgacttgatcttggacttctcagtacccagaactgtgggaaaaaaaatttggctgtttataaactactccacttatgctattttgttataattgctcagagtaagaaatgaagatatttcatcttacttatcttattattgctatttctccagctttggacacaatacttagcactttgtggaaactcagtatattttttaaatgaataaatacataaatgaattcaccaaataggtagttaaagaaccataaaaatcatcatatccttgttttcgaagtgaattagaaccagctgagttgcacagaattgtaaatcagaacatcttgctgatctttatctctgcatacagacctgattttcatagaactcactgtctgaattacatgtgacaacagatacaaggatgtagatttcactttattttgcaaacatgaatttcatcatctacatagtggatagttgattctccagtgaagtcagatttctgaagtgttaatttaatattgtgctattatactttaaaaaaaaaaacatagcacacatcttctagtaaaatggcacatatctttttgcaatagtcaggaactacagacatgagctaaatcatgtatttgaaaggtagtcccagagtggctaagtcagaataaggtatatctttctttctaaagtactgctttgattatattattttctgctcctcaatccacagtagcacctattagcagttctgcctttggcaattgacatatgttatctcctgttgctatttatcaatttactgtcagttatgttctctctctccaattggactgtaggtttttggcaagatgcaatctggaagtaagctctatcaaaagtagttattgaatagatatttgtaaaagattacgatgaaaacatttctaactctccaaatctaactccaccttatctttagtcttaaacacaacgtgaaaattaaactaaaaacattgaacaaattaatcttgacactgtaatatattgcaatggctaaaataattttgaatcctaaatattaattttgttatacatcttttttatatatatttccctgtatggaacatgttatgaataaatacttgatgttctttacacagtctagagcttgctacatattgttgatcatctcagaaacagcttaataaaatcagcatttgaaaatcccagtatcagcacctgtgacattaataattctggtgaaacaggtgcttcctgggaatttcaaacatttgaaaataaagtgataggccggacgcggtggctcacgcctgtaatcccagcactttgggaggctgaggcagatggatcacgacgtcaggagatcgagaccatcctggctaacacggtgaaaccccatctctactaaacaaaaccaaaaaaattagccgggcgtggtggtggacgcctatagtcccagctacttgggaggctgaggcaggagaacggcgtgaacctgggaggcggagcttgcaatgagcctagatcgcgccactgcactccagcctgggcgacagagcaagactccatctcaaaaaaagaaaataaagtgatacttcgagggaattagttgtgtcacagataaaaatagattgtgcttcactgcactcattttaaaacatagtgactgtcttcaatgctactttacaagtgaggaccagataattaactgaagtttctttctcaagcctgattgcgttgtttctttttcttcactactcttctcctttactgtcccttcaccatttaggaggaggatatgcttttctacacatctgttccttaggaggatggttgatacagctaccaaaaaaatttgtttcatgttttaaagtaatcatcattctcagtaaactatcccaaggacaaaaaaccaaacaccgcatgttctcactcatagatgggaattgaacagtgagaacacatggacacaggaaggggaacatcacactctggggactgttgtggggtggtgggaggggggagggatagcattaggagatatacctaatgctaaatggcgagttaatgggtgcagcacaccagcatggcagatgtatacatatgtaactaacctgcacattgtgcacatgtaccctaaaacttaaagtataataataataaaaaatatgctttgcagagttaaagcaaagaaaaagtcgtaaaagacaaactatattttgtctgtgagagccagcttgttaagacagaaaagttgtttcttttttacatttctaaaacttggttttaaatgtgaagagacaaatactaaaagcaacagaacttaaggtttctctgtaaacaaatgtgtttgtttcagtcataccagatattatgacaaacaaatgctaagtttatgagatttaaaaccatgaaagtatatttttgaatgcattaaaataccgtgaaggtgttaatggttcgtaactgggagtggcacaaaggccagttctgcctcctgaaatcattgacagacactgagctgatggaagatttgtttttttaaatatatctcttttaagatcatcgtgggtgttaacaggtagccaagaatgtaagaaggagaatattaaggttgtacatttgcttaactgccttggtctaggaaaaaaaaaatatcttccatgtactttttagcctgaagaagttacttgaccccagtcagataaaaagaaagctgacaaataaccatatcccaggaataactctgttttctacaagaggactaaaacaggaagccaagggaatgagtctgtggttatcattttctaaaaagtgggctctgtcccctgtcaatttctgaagttgaaattttagaggtagagagaaacagaaaccaacacataggtatgggactcagagaccagagagtgtttgtgctcaacttgctttatggaactcagaagagatataatctcatggagaattcactgctcacacaggctagcatcagcagaattgtaatggtggcaaaacagtatagtccgatatatagattgaaataggacccatcctcagtctatcagaggtccttaacgatgcaggagatcatctgaaaatagcttgtcctgtcccatattgattcaagataggccagagagaccttttagttgcaaaggatagacagagtaaatagcaagtacctaatgactggagaacagggtagcagcatagacatggatatcaagcttaagtagggataagtgttgacaacctacggtatgctggcattggtggggtgaggttttcttctccttagaaaagaattcagttaaatagaggtatagaagaataaatagaagtatttaatgatatggcttagcttggtggtttgaaatacatgcctgctacatctggattctgaatatttctgtatttgtaaccatctcaaaaactccagggtattaataaatttgtccataaatacttaacaattggaaaggcatatggctttagatttaccttttcatttcaggattttactcattaaatcagtattagatgctgcagcataattaagttgaagctgacatttgagaacattatttgtttttctctttcatgacatctaaatacatttgatattttttcccaattgccaatcaagtattcttccactagaatttacttttacctgattttaaaagaacattccaatcatggttggtagccatatggacctctcactcaactacaatgtcagtggctctgggagctatttgtctgtgtctgagtgataaaatctttctcagttccctttgagataattttcctctcattttctactgccaaatggacaatctttggatttctccctgaagtggtctttattctcaagtgaccttcaaatggtttacctctgagatattcccacagcacacccaaagtgaagatatagccccttcaaagttggcaacaatacatctagaagttttctcatggtggtaaaatagacaataatttcattttttctaaatagactcactcaagtcaatatccacacagcttcccacacacaataacccattccttttgtatacccttggtgccttagtctaggtcttttttctgaccatagcatccttcattatcttttcagatctcacttctttcaacatcaagccttcttatgtccagtgataagatttatgtctttttgtaagaattttatgtatttattaaaaacatcatttaattgacttaatcagtttcattgggattacttttaaatctttattaaagatccttcagagcaagggccattttatacatcttttttggtaatttttctatattgttacctaagttcacattatcatagagattaatcagaccacacaaaacagtgaaattgatagtgactatagagttagcctgagtgttcagtacaggatgactggctccttttgaataataaagatgatctctaaaataatagcatatatctcattaatacaattatgatatcttgaactgtgcaggacaaacagtcctatttttattatatgaaatagtctttgtaagtatctaattacctacttcccttgataacactgaaaaaagaccttgaatcttaaaaatttccactttaaagtaagtatagtgcaaggacagatcaatgtagtactatgtttttatgccctctctgcagcgagtttatatataacctgaacttttcatagctcccaaatccaaaaaaaaatgcttgcaaccataatttactttttacatttaaactatcgacaataacttcatagcactggtccagttgctcatttcacttgtgaaaggggtcaaattttcacctagagttttattgaatgccacattttatagtaactgttactcaggcttattgtttctcacagttgtttgtttatttttgtgtgtgtgttgttttctcctatgtttatcatcacggttgcttcctgaggaacttttgctagtcgtcgcttcaaagtaatatctccttttcaagaatgggtaacttgataacaatgaaacaatcaaggtattgactcagaaagacttaaccaatgtaaacacacttctctttactgatattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtctcttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgttgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctataaacatatgtgtgcaagggtccttttcatataatgacttgttttcattgggatatatacccagtattgggattgctggattgaatggtagatgtacttttagctctttaaggaattttgatactgtcctacatacaggttgtactaagttccattcccatcagcagtgcaagctgctttttccctacatccaccccaacatatattgtttttcgacttttcaataacggctattcttgcaggagtaaggtgctcattgtggttttaatttgcatttccctgaagattagtgatgttaagcatttattcatatgtttgattgctgtttgtgtatcttcttttgcaaaatttctattcatgttctttgcttactttttaatggaattatttggggttttttccttggtgatttgttggatttccttatcgattatggatactagtcctctgttggatacatagcttgcaaatattttctcccattctgttgatcatctgtttactatgttatttcttttgccgtgcagaagctttttggtttaattaagtctcatttatttattttggtttttgttgcatttgcttttgtggtcttagttataaattctttgcctaggccagtgtctagaagagtttttgtaacactgttttctagaatctttgtggtttcaggtcttaagtttttgatccattttgagcttacttttgtatatggtgagagttaggaattcagtttcattcttctacacgtggcttgtcagttttcccagcaccatttattaaataaggtattccttcaccaacttgtgtttttgtatgctttgacatatcacttggctgtacatatttggctttatttctgggttctctgttctgtgccacgagcctatgtacctacatttataccattgccatgttgttttggtaactgtacccgtgtggtacaatttggagtccagtaatgcgatgtctctaagtttgttcatttgcttaggattgctttggctatccagcctctttttaggttctaaattaattttaggcttgctttatttttctaattctttgaaaaatgctgttaggtgtttgatgggaattgcactgaatctgtagattgctttggcctgcatggtcattatcacgatattgattcttccaatgaataaacatgggatgcatttccatttctttgtgtcagctatgatttctttccagagtgttttgtagttctccttgtagtgatctttcacttccttggttaaggtatattcctggatttcttttttatttatttattttttattattgacagctgttttaaaagggattgaattcttgcttttattctcagcttggtcatttttggtgtgctactgatttgtgtacattgattttgtaatctgagactactcaattcatttatcaaacctaagtgtctttggaggagtcttaggattttctaggtattcaatcatattatcggcaaacaacgataacttgacttcctcttttccaatttggatggcctttatttctttctcttgactcattgctctggctagtatttatagaactatgtagaataagagtggtgaacgtggtcatccttgtcttgttcctgttctcagggggaatgctttcaacttttcctcattcagtatgatattggctgtgggtttttcatctatagcttttattattttgaagtagttttcttctatgcctagtttattcagagtttttatcataaaggggtgctggattttgttgaatgatttttctgaatctattgagatggtcatgtagttttgtttttaattgtgtttatgtgatgtttttaattctgttttctgtgacgtattctctctcgatgaatctagctaatagtctatcagttttattttttcaaacaatgagttttgcgtttcattgattttcatatatttttgtgtttgaattttattgagttctgctctgatctttgttatttcttttcttcttctagctttaggtttattttgttcttgtttcttctgttccttgaggtacgacattagatcgtcaactgtgcttttttagactttttgatgtaggcatttagtgctataaagttccatcttagcactgcttttgctgtactcgaggttttgataagttattgcactattattcaattcaaagaatttttaaagttttgtcttgactttattgttaaccagataccattcagaagaagattatttaatttccatgtctttgtatagttttgagggttctgaaactgcctttgcaaaattataactgaggaaattatgacagtgcagtgaaataaatcagaacttactaactctatcttgcttctaacccttaagctgtccttgttcattcctgggtgtaggctggactaactttgggaaggaatttagttcatggtttgactctgaaacaaaactgataacaaccctttcttgcctggtgtccagtctgctttttcaggactaataaattagctacaagattaaaaattataatttaggggtcatacagcctctggctccaagagtctgaaaatccacaaattgctcctagggataacaccactattgtaaaacctaagatcagtgcttgagatattttgcagaccctgaactccatagatcagccaacaccacccagaccagtaatctggcccaaccagttctgccaatgcacccaagtacagaagacattaagaaaacctaactttgacctcctatggttccatctccaacttgaccaatcagcacttcccatttcccaagcccctacccaccaatttatctttaaaaagtctgattcctgaattctcggggagactgatttgagtaataataaaactccagtctcccgcatggccagctctgcatgaattattttttcaccactgcaattctcttttcttgataaatcagctctgtctaggcagcaggcaatgtgaaccaattgggctgttacagttctttgtgaagttgatttctagttttattctgctgtggtctgagaagatatttgatataatttccattttaaaaaatttattgaggcccgttttgtgacctattatatgatcagccttggagaatgttccatgtgaagatgagatgaatgtgtattctacagatcttaaggtaaaatgttctataaatacctggtaagcccattagttctagtgtatcctttacatttattgtttctctgttgactttctgtctcaaagatttgtctagtgctgtcagtggtatatagaagtctctcaccattactgtattgctatctcattacttagatgtagtagtaattgttttatgaatctaggagctccagtgtttggtgcatacatatttaggattataatatctacttattgaatttatccttttatcacatatgtagtaatgatctttgtctttttttaaatttttgctgctttgaaatctgtttggtcttaatatgagtatagctgctcctgctcacttttggtttccatttgcatggaataccttttcctacccttttactttgagtttatataaatccttccctgttaggtgagtctcttgaaggcagcagatatttggattgtgattttttaaatccattctgccattctgtatcttttaaatggagcatttaggtaacttacattcaacgttaatattgaaatgtgaagtactgttctcctcatcgtgttaattgttacacagatagtttcttttcattgcattattgttttataggccctgtgagttttaagcttttaagacattctattttgctgcatattgggtttttgttttaaggtttagaacttcttttagtatttcctttagtgctggtttggtagtgacaaattccctcagcatttgtctgaaaatgactttatttctcatttatgaaactaagttttatgggaaacaaaattcttggctgacagttgttctgtttaagaaggttgaaattaggaccccaatcccttctggcttgtaaggtttccgtggagaagtctgttcttagtctgataggttttcctttatggtttacttgatgcttttccttactgttcttagaattctttctgttgactttagatagcctgatgactatatgtcttgctgaagatctttttgcaataaatttcccaggagtcttttgagcttcttggatttggatatctagatctctagccagaccaggaagttttcctcaactattccctcaaatatgttttccagatttattattttcacttctccctcaggagaaggaaagccaattattgttattcattttatgtatttccatatttcttagagactttgttcatttttattcttttttatttttgtctgattcagttaattcaaaagccttgcctttgagctccgaaaattctttctcctagttgttctagcctattgttaaacatttccacggcattttataattattgcccaagtgtatcttttattttcagagtttctgattaatttttctttacgatatcactctagaaaatttttcattcatatcctcaactgccttctaaatttctttatgattttttttttgcctttctctgatatctccttgagtagcttaataatcaaccttctgaatttatctggtatttcaaaaatttcatcttggttgggtccactgctggagaactagtgtgatcttttgcgggtgttatagcaccatgttttgtcatattaccagagttatttttctggtccttctcatttgggtagactattttttctaattattctttattttacatttgatttaattgtgtttcctttgtttgtttgcttttaatttttttcctctttaaggatgagacttcaatgctttgagttaattgtagcctaatttggttcttggtgctttcagggtcaaagactctgaagagtcccttggttatagaaagtgtttgtatgatggctttctcatatgctggtatagtagcaatgggctcagtgtggaaacaaattcagtatctcctatggggttggaatggtagaggtctcttaaagcttatctcattcccctgtggtggcactttatttatttatttatttccccccatattttatttactggtttgatggttcagatttcaggccagtaggggaggtatccctgggtagggaccagttgtaggtaaagcaggtggataaataaagtcccagcattgacagaggtaagtggaggagcttaagtgagttgcactgaggttttatcaagtgaagttttggaaccactttagctccctgccaggtcagtaggaaagttatccacctctcagacatgctactatcccagtgttctggttattcagatcaggcaggcacccttttcatctgtagaaatgttgaccttccaagtagagaggaattgtgactctgtctctcatgcaagcctgaacccaggtagtgctccttctgtggggatgcagtaccctgatgtgttccagaaatgctgtctatggttgcacccatactgagctcctgttggagaaacccaaactgcgcctatgatggtggataaggggggaaaggcttcctcttctccagtactcttcatggataccaggactgtctgactgttggaactgtctgactgagagctgaagaccttccctgcctagccccgcacctcaacagtactgctgctgaaggaagctttccaccagtggaaggatcctgtggtcaaggcctgccatctggattcttttgtcttacagtgtgttctcttggggttggaatggtagaggtctcttaaagcttatctcaatcccctgcggtggcactttatttatttatttatttccccccatgttttatttactggtttgatggttcagatttcaggccagtaggggaggtatccctgggtagggaccagttgtgggtaaagcactctcccttcccctaggagtgggaatccctgggagccagactactgtgggtgttgttgctcctctgggtctagctgctcagtggaattgccccactccaggctggtgttggggaaatgtttgcaagggatccactgatgtgacctgtcctcaagttttctagcagtgggtaatggcaccagctctaatgggagtggcaaaggagtgacatagattctgtgaagttccttggttattgatagtcttagtgtgttggctttcttgaacactggttatagcagtgatgaactggtcacatggacagattcaggagcccctggttagccagagcggtgtaggcaatggtgatagctgagatgcacagccttctccttcttggacacggtgttattctaccaagaaatacagtaatggactgtgtcggttgtcctgcagccaggaggtggtgcttgccaaaaagcatcagctgtggtggcaaccgtggcagttttgcttgccttatgtttcctgttggaggggagtatctctgatttctcaggcaatgggcagggccaagtagctcccaagagattttgatctttttgttgagctaccagggccgatggcagggcaaagccaggtgggagctgggttgggcaggtttgcattctgagtctctgtgtgtagggcaaacagcagcccctgtgggtttttggggacaggggcaggtttcaaaccgctgggttgatgttccagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttggtaaggcggtaatcagcactcaccactaacagtagtcataagattttcccacagagaaagcaaccatggcttttaggccttgcccttctctgtctgctgcaaagccaggcacctggcatctgcacccagggctcctgcacccatgggcctacactcatgactcttgcactcatggcacgcttttcactctccccatcctggccctggccaagggagttcgtgtccacccaaagttatattattaaatccctttgggagcctctttctacctgtggccaccacttgaaatgtttggctctcttcctcagcaccctttgtgaggaacagtaaagaatagctaccctcagttcacactgggatctaggagtccatgcaagggtcttcccactgctgatcctacttttatactccatgaccctccccaactctgtttctgcacagggtggggttagggccttcccccgtgtattgagctttcagggtccccagtgggagtgtatatcctagaggcaaactctccccttctcatactctatgtactcacagcctttgcctgactcacactgtaggctgcagcctctagcatccttcaaagtgtccataaattcctccggttttcctgttcagttcctgtgtcacttcttgaaaaaaattcacagtgtgaatctctgcacactattttgtccttccaagtgtgagagatatgctagcaatgccttcaatccaccatcttggggggaaaaaactctaatttgcttttaaattagattttgtattaagacttttaataatcaaaataatcactgaatgctgaactgaatttttaaaatattaaaaatagcaatagttcagtctgttaatcactaacctaacatacacatttattaaaaccctatttccaaagttgaactgtaattaagtttgtatggagagattcacataaaagttaccccattacttctttagtagtttttttgttgttgttgtttgtttttgtttttgagatggagtcttgctctgttgcccaggctggagtgcagtggcaccaacttggctcattgcaacttctgccttgctggttaagtgattctcatgcctctgcctcccaagtggctgggattacaggtgcccaccactacacctggctaatttttgtatttttagtagagatggggtttcaccatgttggccaggctggtctcaaactcctggcctcaagtgatccacccgcctcggcctcccagagtgctgggattacaggcgtgagcgaccactcctagaccctttagtagttttatagtttgggctcttatgtttaagtctttaattaattaagatttttttaatatggtgagagatagggaatctagtgtcattcttctggatatgaacatctgttttcttcctggaccatttatcaaagatggtatctttcctcaatgtatgtttttggagcatttgttgaaaatgttccaatagtcacaaataaacattctattaaaaaattttttgaataatggttagcatctacattacagttaatagctaggtcttactgttaataattgactaatgaactgttatactaatattcactttcaaaaccatcataaaaaaacagttttatgaaatagatacttttagaattaatggttaatgaaaacattcatttttttctataaagttatttttgtgtaatattttttcttttttattgatacgtaataatagtacatatttaagaggtgcatgtgtgattttactacaagcatacaatgtataatgatgatcaattaaggtaattaggatattcatcacctcaaacatttatctttttgagtgttgagagcatttcaaatctttacttccagctattttgatatatacaataaactattgcttatgtccccatccctaccctcatttatgcactttttccagcctctggtacctatcgttttaccctccctacatgagataaactttttaacacccacatatgagtgacaacatgcaatatttgtctttttgtgcctggcttattttacttaacatagtccatcagttccatccatgatggtacaaatgacagagtattatatttttatggctgaaaagccttttatttataaagtttttatctgttaatctgttcacaaacacttgtattggttctatatcctggttattgtgaacagtgctgcaataaacatgggaatgcaggtatctacttaatatactgatttcctttcctctagataaatacccagcagtggcattgtggggtcatatggtagttctatttttagatttttaaaaatgaacctccagactgtttttctataatagctgtactaatatatatttccaccaacagtatataattctcttttctccatattcttgctatcatttgtgtgtgtgtgtgtgtgtgtgtgtgtgtgtgtgtgtattttgataatagccatgctaattgggtcgagataatatcttactgtgattttgatttacatttccctgatgattagtgatgttggcatgttttccatattcctattgaaaacttgtatgtctacacttgagaaatatatattaatattatttgcccagtttttagggagattatttgattattctgttgttgcattgagttcctcatatattctgcatattagtcccgatggatgaatagttcacaaatattttttccagttctacaggttgtacctttactatgttgaacatttcttttactgtgtagaagctttatagtttaatatagtcccatttgtctatttttttgttttgttgtatgttttgaagtcttagtcataaaatatttgcattgactaatgttttgaagaatttctcctatgttcttgtttagtagttttatggtttggggttatatttaagtctttcatcaattaagtttttttaatatgatgcaagatagggaatctagtgtcattcttctgcatacggatacctgttttctccaggaatatttatcaaaaatggtgtctttcctcaatatatgtttttgaaacatttgttgaaaattggttggctgtaaatacaataatctatttccaggttttttattctgccctgttggttaacgtgtctgcttttgtgccaatatattgctgttttggttaccatagcttagaagtatatcttgaactcaggtagtgtgatacctccagctttgtcttttttgcttaggattgctttggctatttgaggtttttacggttacaatttttcttttaatttctgtaaagactatcatttgtattattttttttgagacagactctacctctgttgcccaggctggagtacagtggcacaatcttggctcactgcaacctccacccttcaggttcaagcaattctgctgcctcagcctctcaagtagctgggattacaggttcacatcaccatatctcgctaaattttttgtatttctagtagagacagggtttcaccatgttggccaggctggtcttgaactcctgacctcaggttaactgcccacctcagcctccaaaagtgctgggattacaggcatgagccaccatgcccagattgtattttgataggaattgcattcaatctgcagattgctttcaatagtatggtcattttaacaatatcaattttttcaatcgttgagcatggaatatttttccatttgttttcatcctcttcaatttattttatcagtgctttgtagttttcctaatagagcaattttcatctacttgtttaaatttattcctagttatttttatagctcttgtaaatgatattgttttcttatattcttttttttatctagtttgttattggtgtatagaaatgctactgttttatatgttgattttgtattctgcaagtttactgaatttgcttatcacggctaagaggtttttggtggaatctttaggattttctatataaagactgtgttatctgcaaaaagagacaatttgtcttcctcttagattggagtgtgttttctcttctttttcttgactaattgctctggatatgatatcaagttctatgttgaataagagaggtgacagtgggtatccttgtcttgttccagcaggtttccaccttttctcaatttcaccttttctcaattcagtataatgttagatgtggtttgtcatatgtggtctctattatgttgaaatatgttccttctatgcctaattagttgacagtttttatcatgaaaggatgttcaattttatcaaatgttttcctgaatctattgagatgatcatataatttgtgttcttctttttttttcttttttttgagagggagtctcactctgtcacccagactggagtgcagtggcacaatctcggctcactgcaacctccacctcccaggttcaagagattctcctgcctcagcctcctgaatagctgggacaccaggtgtgcacccccatgcttggctgatttttgtatttttagtagagatggggttttaacatgttggccaggctggtcttgaactcctgacctcatgatccactgcctcggcctcctgaagtgctggaatttcaggcatgagccaccacaccgggctgatttgtgttcttctttctgttaatgtgatttatcaattctattgattagtatatgttagatcatttttacatccctgagataaatcctacataatcacagtgtaccacctttttcatgtattattggattcagtttgagtactttattgataatttttgcatctatatacatcagagatattagcctgtaattttcttttttgttgaattcttgtctggttttgtaatcaggtttagctggccctatacaatgacataggaagaattccctcctcttcagtttttttaaatagtctgagaagaatagatgttagttcttctgtataggtttggtagaattcagcagtaaagccattcagttctgagcatttctgagttgggaggtttttttcagctattattgcttttgattctatctctcttatagctcaaataatatctgtttttcctatcagggtgctgtggtgttggtgaatataccttcacaaatgttatatactcttgaaaattgattcctttattattatataatgatgtcctttgtctttttttatgtttttgacttaaagtttattttgtgtgatgtaagtgaagctactcctgcacagtttttgtttccctttgtgtggaatattcttttctgttccctcactttcaatctatgtgtgtcttcacaggtaaagcaagtttcttgtcaacagcatatagttgggttttgtattttttatccattcagccagtacatactttttaagtaaggaatttaaaccttttacgttctggaatgttattgataggtgacaacttactcctgtcattttgtcaattattttctaatgttattgtatattgtttctttcattctcttattttttacatttacaatttgattatttttgtagcaacaacatttgatagctttctctttctcattcgtgtatatactctaccagtgaacttagtacttttgtgtcttttcatgagggtagatatcttttcactcccagattttgcattttcttaagcatttcttaagcatcgtaggatcaacctattggtgacaaattcccttggtttttcttgcctgagaaaggctttatctctccatcattttggaagaatagctttgcacagtttattattctttactgccatgttttgttctgttttgttttgttttgttttgtattgttagtactttgaatatcccattctttcctggcttataaggtttctgctgaaaaattttgagaaattagctgttgatctgatggggatttccttatatttgatgatgttttttcttgctattttgatggttttactctaccttaaacatgaccttttagaattgaatctacttgggaatatttgttgcatttcctgtatctgggtgaattcatgtatatggatgcttcttataaatggatgcttcttataaatggatgtatatattttgttcaagacttgagaaattttaacctatcattttgttacataagttttccatctctttttctccacaattcccaaaatttgaatatttggttactttatggtgtcccatatgtcacataagctttcttcattctttttaagtccttttttcttcttttgtctatgacatttcaaaagacctgtcttcaagtcagaaattctttattctgcttgatgaagtctattgctgaagattttgattgtatttttatatcactgattgaattcttcacttcaggatttctgtttgtcttttttatcatatctagcaatttatcattcagattataaattattttctaatttcccaattgtttatctgtgttatcttgtatctggctgagttcttcaatattattattttgaattcctttttagatattttatagatttttcttttttgtgatttcctactagagaattattattttccttcggtggcattatgtttccttgctttttcatgtttcttgcatctttaaattgacatatcagcacatcctgggtgacagtcacttacttcagttacatggattggcttttacgtggaaacactttttttcaattgctgagcagttctgctttttaaagcagcaactgagctgtaaagcagacccatccttagacaggaaactgaatctacgtgggaggaagacacagtggtgggcaatctggaagctagaaggaaggacagtcagagtgagtattgtaaagccagaagcatggcttatctaacaccccgctgggatatctaagagagcccccttctcaggtttttttctgtctcaaaagaaactgaggcatgggtagtgataaaatcacaagtaatctcaccctaccaaaacccagtctcctcattaaatgctacagaagtctggaaggagttctcattatacaggcctatgacactctcactgtccaacagtcttcatttctggttttgttcaagattatatccctctcacacacaaagaaagcatttatcatgagagaattttggtactttatgaagttgtctgcctttaattatttatattgtcttctttctcttagtatttttgttttttttttctttagggaagggatagaggggactgtttttgatattgctattcttcttctgtcatctaggtaaagcttcctttgaaaatgccaacctgtttgaacactcctcaggagacatgatgaaagatgttctctataatttatctgtatattcccagtttccaaatatggcaataacagcaagaataaacagacggatatctcaataagatgaaaaattagcaggaactgatgaagggacactcttatcgctgttgctttccattatgattgttgaactcaaacagctcttcctgtgtctcaggcagaatcaattatagatagaaaattaacttacaaatatctttatttacttgattaggaaaaggatactgagtagtcagcaagtaatagttaaaaagaaatcataaaattggaatcacaagatctgtgttccagggcttcctttgactttaaaaagtggattacccttaactgagtcacatacttctttaagatttttttatatcatcatctgtacaacaggaacagcaaactagaagatctctgagatccccttaaattttaaattgtttcaaattataccctaagatatctgagcaagaaagatttaaagagcaaaattttacctcaacagagatgagagtttgttagtgtaattgagggggtcaaaacaaaataatatattgttaaatagtgggtgaagacttagagtgatagaagtcttttccataaaaaaatttagtttttaataaatcctttcactgacatcaacacagtaataaaggagaagcacctataacacggcttcaatagcaatttttacagcaatgtgtaaaacatgccatcagagaagaattcctgttccttaaatttccacgttacccagcatctgccatagctaacaggaaatgaaatagaataaactatggaaagatattgaataaagactccttaactatggagtttgataatttgaagtaaggaaataagaattctctgcttttagaataagaaacataattccaacaaatgaaaaatctactgtttctccctgtggaatgtgaacaatctagcataggtttctgaagggaacctggcgctatggtagaaaatgatcagaactgtattgatttacatatgtttcttactcttataggcatataggagccttgcatgaccacactttaaacaaatattttcacagtatttattattgatagcatacatgcattaaattgttttttataaactctaataattaacttcataaaccgtcttaaataaatgtttttcttatttgtataatgaccttagtttaaaatgtaacctttcagatattttcagaattacgtacataaagagggtgaacctatcttagaaatacaatagtttccgctttccagaacaataagactaatgaaaaaccgctttaaataatgttgcttgagggatggtttctctctaaacaccagaatgtgtagaaaatgtttacacggcaaaataaataacctgttaagaggcttaaaattttagttagaacaataatatacacagtcaacataaaagccttgtttacatggttgtttgggaatattttaaaacaaaaacagtttgcttcatattcagatctcccatggctcccaaagaagactttagttagagaaaaagagttgtttaaataaagagaattcatttatttctgttatagtgtaataataataactagtcatttatagttattcatacatttgtataatttgaacaaaagccatcagcctgaggctttctttctcatttctgcaaataaagatatagagtgtttgaggaattcatgtagtttgcaaatatttgcttttggagacaaatgatgataattaaataaaatgctgtgtgttttgttgaatgagcaatgtaataacatttaggcatgtaaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgcattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaaagggatgaaaaagcatatttcatgccaatgtaaaccaaaaaggagcaagagttgtgatacttatatcaggcaaaatagatttcaagactaaaactgcaagagacaaagagggtcactatataatgataaagggatgaattcagcaaaaggagataccagttttaaatatatatgtaccccaacatttggagaattgagatatataaagcaaatattatagctaaagagagagatagacctcaatacaataatagctggagacttcaacaccccactttcagcattggacagatctactgaacagaaaatcaacaaggaaatatcaggcataatttgtactagagaccaaatggatctaatagatatttaaagaacatttcatccaatggttgcagaatacacatttttctcctcagcatattgattattctcaaggataggccatgtgttaggtcacaaaacaactcttaaatatttcaaaacaaattgaaataatatcaagcacattttctgaccacaaaggaataaaactagataataacaagaggaatttgaaaactacatgaatacatgaaaagtaaaaattgtgcccctgaataaccagtggatcaatgaagaaattaagagaaaaattagaagatttcttgagacaaatgataatgaaaacacaacatacgaaaacctatgggacacagcaaaagcagtactaagatgaaagctgatagctctaaatgcctacatcaaaaaagagaaaaaacttcaaatatacaatctaatgacgcatcttaaagaactagaaaagcaagagcaaatcaaacccaaaactggctgaagaaaataaataataaaaaatagagaagaaataagtgaaactgaaataaaaaatagaacaaaagtcaacaaaacaaaaagtagtctttttaaaaagttaaagtaagtggacaaatatttagccagactaatagaaaaagagagaagatgcaagtaagattagaagtgaaaatggagacattacaactggtatttcagaaatttaaaggatcattagcagctactatgagcaactacataccaacaaattggaaaatctagatacaataaatgaattcctagacacatacaatctaccaagattgaataatgaagaaatccaaaatctgaacagactagtaataaataacaagatcaaagccataacaaaaagtctcccagtaaacaaaagcccaagacctgatggcttcactgctgaattctgccaaacatgtaaagaagaaataatatcaatcctactcaaactattctagaaaataaaggaggagagaatacttccaaactcattcttcgaggccaatattcccctaatgccaaaactggacaacaacacattaataaaaaataaaacctataggtcagtatctcttataaatattgatgcaaagatcttcaacaaaatactagaaacccaaattcaacaatacattagaaagatcatccttcatgaccaagtagtatttatctctgggatgcaagtatgattcaacatatgcaagtcaatcaatgtaatacatcaatagaatgaaggataaaaagcatctgatcatttcaattagtactgaaaaaacattttataaaattcaatatccctttatgttaagaccctcaaaaaactgggaatagaaagaacatacctcaacataataaaagcaacatatgacagacacacatctagtgtcatacggaatggggaaaaactgaaatcctttcctataggatctagaacatgacaaggatgcccactgtcaccagtgttatttaacaaagtactggaagtctttgctagagtgatcaaacaagagaaagatataaaaggcatccgaattgaattgaaagaagtcaaatttttcttatttgcttaggatacagtcttacatttggaaaaacctaaggactccagaagaacactactagaactgatcaacaaattcagtagagttacaggaaacaaaaccaacatacaaaaatcagtagcatttccatatactaacagtgaaaaataaaaaaaattaaaaatagtcccattatactgaccaaaaataaaattaaatgcctacgaattaatttaaccaaagaagtaaaagatctttacaattaaaactataagacactaataaatgtaactgaagaggaaaccaaaaaatggaaaaatatttcatgttcattgattggaagaatcaatattgttaaaatgtccatactactgaaccaacatataggtttaatgctcaaaataccaatggtattcttcatagaaatagaaaatacaattagaaaatttatatggaaccacaaaagacccactaccctaagcaaatagaacaaaactgagggaatcacattacctgacttcaaaaattttgctacacaactatagtaacaaaaatagcatggtactggcataaaaagagacacatagaccaaaggatgaatgttgagagcccagaaataaatctacacaccaacggtgaactcattttcaataaaggtaccaagaacatacactggagggaagacagtctcttcaataaatggtgctgggaaaactggatatctatatgcagaagaatgaaactagatccttccctctcaacatataaattaactcaaaatggattaaggacttaaatctaaggccccaaactatgacattggaaaaatcttcagaacattggtctgggcaatttgtagtgcactgggagtgtcataataccttgttttttcatatttcctgtattattatgctgattttttgcatctggagaaatagttgcttctatttatttttgaatttattttgttggggtggggctttttccccctgagaatacaacaatgatgtattttgaatagggccgtatggctttgcttctgagtacattcattgttaaagactgcttaagttttttggttataaatagccttaatatagtggcttcctcaaatgctggtagtagtagcaagagagcttgtgcacagcaaccaaaataacagagtaaacaacaacctacagagtggaaaaaagtatttacaaactatgcacatgacagaagactaatatccaaaatttacaaggaactcaaacaactcaacagcaataacaaaataatcccattataaagtgagcaagtgacatgaatagacatttttcaaaagaagacatacaaatggccaacaagcatataaacaaacattcaacatcatttctcttatcattagagatacgcaaatttaaaccacaatgagatataattttaccctagtcagaaagactattattaaaaagtaaaaaaataatagatgtttgtgaggatgtgaaggcaaaagaatgcttagtaaattaatacaacctgtttggagaacagaatggagatttctcaaagaactaaaaatagaagtaccatttgatccggcaatcccactactgggtatctacccaaaggaaaagaaaatattatatcaaaaatacacctgcatttgtatgttcattgcagcactattcacaatagcaaaaatatggaatcaatctctatccattgatagatgaatgaataaataaaatggcgtgtatatagataaaatgctatgtgtagatacacacatgcacacatacatgtatgtgtatatatgtacatatatacacatatgcaaacatatatataacatggaatactattcagccataaaaaaagaatgaaataaatgaaatcatgtattttgcagcaacatagatgaaactggggacattatcttaagcggaacaactcagaaacagaaaatcaaataatgcatgttctcatttacaagcagaagctaaataatgtgtatatacggacatgaagtgtgtaaaaagagacactggagactcagaagggtggtgaaggatgagaaattacttaatgggaaaaaatgtacattatttggttaatggttacactaaaagcccagacgtcactattacacattatatccatgtaaataaactgcagtgtaccacttaaatttctacaaaataaaattaggaatctttgtttataacagaatgaaaaaaataagccactgattgggaaaagctatttgcaatgcacatacagtaagaggcttttaatagactaaataataaaccttcacaaatatataaaaaacagaaaattcaatagataaatgggcaaaagctcacagattcttcaaaattaaataatactaaaatgacaaataaacatatatagattctccacttcattattattcagagaaatgcaaattataaccatagtgacctatcattatagaactgttaagtttaaaaagactaataatggaacagctggtgaaaatgtagaccaagagaaacttatggatacttcaagacatcgtgttgtatatgataaatacatacaatattatgtgtcaaatttaaaaattaaaaattaaaaaataccatctgagggatgtgagatattgaattcttaatacaatttaaattttcttaatgttgattcagattataatgatgaagataattttaacagtgatttggtgaatgataaaaaatagctagctgttttacaaacggactacttaaatgatgctataatgtaaaagcaaattacacaaagtgagatttaattaaggaggatataataatacctcacattttttgattttttaaaatagaattgtgtttagcagttgaattgtcttatttaatattcataaaagcctgggcaccagacactatcatcaaacataatttagaaataagaaaacccaccaggcgcggtggctcacacctgtaatcccagcactttgggaggccaaggcaggtggatcacaagatcaggagatcgagaccatcctggctaacatggtgaaacccgtttctcctaaaaatacaaaaaattagccaggcgtggtggtgcgcgcctgtaatcccagctactcgagaggctgaggcaggagaatcgtttgtacctgggaggaggaggttgcagtgagctgagatcgtgccactgcacttcaggttgggcagcaagagtgaaactccgccaacccatcccaaaaaaagaaataaggaaatcaagtattacagagcacaagcaacttttcctaatgttaggtctaggatttggaagtaagcagtgtcatccagaatttgtgttcttgctatatagaggaagtcaaaacaattacctaaacaaaaactgatattcaagattttcaaattaggcaaagttttagtaacttgtattgataaagaaaaactgcctagaatatcaataaagatttatgaattttcaggattaaaaggaacctaagatgccattctctagctgaacactatttcatcttcctttggacatcattgataattggctcttcattcatgtgaggctccacacattagaaaaatattcctttagtagagctgaaatttgtgttatgttttggtttgttttagcttccaatgactgaccctaactctgtccctgattaatttgcagtctaatttatattatactgggtcgttctgaaacaattagataaacctatcaagtcatacataatttcttctctaaatatttcctgttgtttcatttttttttccacatggaatgattcctgatacctttcctcagggtatgctcatttgtcaacatcccttattgataaaattggaaaatttcttaggataattgcatatataaagagataacttatgtccaatatctgggacatgataaaatctctcaaatttccttaagaattcaaagctgtgatagtctcatttgtgtgtggagtagtcccctcttgaaaattacaaactttatttgtttttaatttatgaatgtttctttatttttcctttgggacaaagaaagaaaaaagtatgcatgagcactatctttttcaatataagattatttatttaggttatatttctatgaatggaattgatggataagaaatcgtctttttggatagagactaagttgctgtaatgaagaaaatcccaaaatacaatcaatggcttaaatatgatagaagttcatttctccatcaggaaacagtataattaacagggtaaccctgcctcatgagaacttctagggagggtggttttctccatcttgttctctatcaactaataagacattgcccttatcttcatgaccaaaattatatcattgcaaaatctgctttccagtctaaagaaagcatcagtccagaacaagagatttcacttttattataaattgtaactgacctggaagctgcacacgtaaattttgttctcattcccttgaagagaatggattcaaacaagacaggttggttgtaaggaggctgaggagtgtggtctccagctgtgaagccatatgcattgcttcagctcttttcctgtgaaaagagaacaaatcaaaatttagtgtgtcaaccatctctcctacagagactacattcttttgtttccatgaatctcgaaataattttcaagattctttacaaatgattattatctttaaaatattagtaaccatattaatctgtagtgtaaaaatcaaatttttaagacaagaaattaataataaaatcaatatcgtgtggtaagaaatataattgactcattaagtaaacatctcaagttacagaaacagaagggtgtgagcatattagaaatgtgtatgttgaccacaagcatttgtgctgtcacaggctttagtgagtataatttacttaaagactagagagcaaaatttatcttgcaggttttttcaatgtggtcagttaaggcagcttctcttgtaccaacttctctgtggtacatcatatgttgctctgaacaccacattctcaaacatctgcttaaagctgtcctctagtaatttagagctcactctaaatagtcacattatattaaaataagtaattcacatttctcatgtatgctggtaatttttctagtaaatattgcttatattgaagaatcatttactaatctttttgctgttacatgaaaaagtgtttgcacaaacaaggtaaataagtggaaaccaaaatttgcatgtttagtgatttcagaggatatcaaaataaataataatgcatattgataaggtaaccaaaatcattcggcattccttcaattccaatcatagacaaagaaagcttatgctattcatttgtgacattctggattctctccacctttcatgtgcctattcatttttaagttttgctccaggatagccctattgaactgtacaatttctgaggaaagaaagcaatacatgcagcatttcaaatatatccttgctgttaaacccgagatggctagttcgcaactactcactggaacctgacctaggagagttctgtacagcatgcagccaatgggaaggaaaagtctccaccctccaggaccttaagctttagttagtgaagataaaatatactctaagaagcaactatttaccaagtctaaatcttaaagtaagccctgaatcattcatattttagtcccacatccagttaatcacgaagtcttatattctaacttctcatcttcacagccactagtttataatatttccaacagtgctgtcattcgtcccaccagctctggtcttatctcactgtaatactcccttgcagagatttctttcactgtgcaccttaactttgaaaggtatagataaaaaaaataaattattacatacgagtaacagaaaacaacttagataatgagtcagtccacatgcacataacccatctctgaattagtcaatataatatgctcaattacccactttctccacattcttatgtggcatacttactctatgctcttcaaaaaagatttatattttcagggttgaaatatgattatgtcatctccattctcagttagaatattttaaatataccctcaaaattcctaggtaagtccaaattcccttatatggttcttgaagttctggaagtggtgttaccttgctctctggatttagctgtagttattactctccatgtgtgctaaagtatgccatttaaaactatttgtagttatctaactttatattctttcttgccttggggctttggcacatgctgtttcttgcctaaatgtacccacccctttcatgttgcttgtaaattcctccttgtcttccatgaccctagtctaagaactaaagtatctttcttaaatgctcccataaaaccatgtactcatcttatcataacactgatagtactctgttgacattgtcaactccctgtttcagatgtctatgaaacctcaactccctgattacagagactatatttttctcctttctatactgagtggctagtacagtatctcatgcatagaaaatatacgataattatttgttaaattgaaattcacaatttgtggcatagattagatgcatttgtgcctaactaaaaaaaggaggaggtttctctttactaggcattatgctggatattaatgatttcaaagttaatgtgctaaaattcctgtcattccagaacacatcttagtttgttaatttctttctcttccttttttttttttataagtggtcacatttgttattattttttagaaaatacttgggataaccccaaatttgaatccatatctgcattgcaaatatggggtagagttaactggggaaaacttgaattttctcttgaaacaaaattcttatgtatctagtataaataaattgggctgacctaccaaaaagaatacatagcatggaagggaatcaataaacaattgtttgaaataaaaatgactgagtagatttgctggaataaagataatccaagggccaggtaaaagatatgaagtctatggattataagtgggatctgagtcataaaaagagatttggagaactgaagatgttgagtgactgagttttgatcaagtatataatgggttatccaagtagataagcatataatagataatttttctacaagatttataatgagcaattttaaaacatctgggctagagaaatataaattgagaaggttgaaattatagtgaaattttgaaaatacattagaacatctccaacaatgatagaacatttcagagtctaataatttcagtccttaaaattttggttaaatgttcaagctgggatgaataatttggcctttatagtctcgtttaaaagcttcaggagctgcggtggctcaggccagttgtcctggagcataaggaggcgaggctacacattcaaggccaacctgggcaacataaaaacctctcatccattaaaagcttcaaaaattgccacaatctagaacactgtaagattgttatattttctgcatgagagaattttaaaatattatttctgaaatattgtctttatatatttgagagtgatctaaagagttaataacctccaaatctgcatcctcactgaagataaaataaaatgaaatgtgcctttactgaagcagaggagattcgggaaaaattcaatcaaaaccttcccaagttagggatttctactcacatttacttagaacttcaaggaggaaagtttttgaaaatgatataggccttccaatatatagttggaacctttttatgattctattatttaaaaaaatttgctattttaaaaaatgtttgtgggaacatactagatgtatatatttatgaggtacatgagatatttttatacaggcatgtaatgtgaaataagcacatcatggagaatggggtacccatcccctcatgcttttatcctttgagttacaaacaatctaattacattctttaagttatttaaaaatatacaattaagttattgtcactgtagttttttgagaagcctccaaactgctgtccatagtggttgtactaagttacattttcaccagcagtgtacaagagttatcttttctccacaaccttgcaagcatttgttacggcctggcttttggatacaaatcattttaactggggtgagatgatatctcattggagttttgatttgcatttctctgatgattaataatgttgaacaccttttgatactcttgtttgccatttctatttcttcttttgagaaatgtctatgcaaatcttttgcataattttttattagattattagattttttcctataggcttatttgagctccttatatattccggttattcatccttgtcagatgggtagttttcaaacatgttctcacgttctgtggggtgtctcttcactttgttgattgtattctttgctattaagaagctttttaaatcgatgtgattccatttgtccatttttgctttggttgcctatgcttgtagggtattgctcaagaaattttttcccagaccaatggcttggagtttccccaaggttttctggtagtagtttcatagttcgaggtcttggatttaagtctttagttcatctttatttgatttttgtgtatggtgagagccaaatatctagtttcattcttttgcatatagatatccagttttcccagcatcatttattgaagtcttttgccccattgtatgtttctgacatccttgtcaaaagtgagtttactgtgggggtgtggatttgattttgtgttctctattcttttccattggtctatgtgtctgtttttatgccagtaccatgctattcttgttactaaagttgtgtagtaaaatttgaaatcaggtaatgtgattcctacagttttgttctatttgcttaaagtagctttggttattctgggtcttttgtggttccatataaattttaggattgttttttctatttctatgaagaatgtcattgttattttgatagggattgcattaaacctatatattgctttgagtagtatgaatattttaacaatattgattctatcaatccatgaacatgaaatatttttccattattttgtttcctgttcaatttctttcattagtgttgtatagttttcattataaaattatttcactactttggttaaattaattcctaggtatttaattttatttctggctattataaatgggactatgtttttatacttcatgctgttgatatgatagatcatgttgattgatttgtgtatgttgaaccatccttgcatcacagggataaataccacttggtcacgatgaatgatctttctaatgtattgctgaatttggcttactagtattttgttgagcatttttgcatcaatatttatcagaggtagttttctttttttgatacagttttgccaggttttggtatcagggtaataacgttcctcggagaatgaatttgggagcactctctcctcttctattttttggaatggtttgagtagaatttatattagttcttcaaatgtttggtagaattcagcagaattcagatgaagccatctggtcctaggcttttctttatggggagggattttattatggcttagatctcattacttgtcatcagtctgttcagggtttggatttcttcctgtttcaatcttggtaggttgtgtatgtctaggaattcatttatttcttctagattttccagcttattggtatataggtgctcatagtagccactaatgatccttttaatttctgcagtatcagtagtgatgtctccattttcatttctgattttattaatttgtatcttctctcttttttcttagtctggctaaagatttgtcaatttaatttaacttttcaaataacctactttttgtttaattgactttggaattttttttcaattctatttatttctgctacaatatttatcatttattttcttctactaattttgggtttgatttgctcttgcttttctaattctttaagatgcattgttagactatatatttgaggtttttttctctttgttgatgtaggcacttaatagctatcggacttccatcttagcatcgcttttgctgtatcccagaggttttggtatgttgtgttccatcataatttgttttaagaaatatttcaattttcttcttagtttcttcactgacccactggtcattcaggagcatattatttaatttttgtatatttgtatagttttcaaaattcatgttgttattaatttctagttttattccattgtggtcagagaagatacttaatatcatttcagttttttgaatgttttaatccttttttttgtgaacatattgtttatacttgagaataatccaggtgctgagaagaatgtgtattctgcagctcttggatgcaatgttctgtaaatatctattagattcatttggtctatagtgaagattacatctgatgtttctttgttgattttctgtctggaagatctgtccaagatgctgaaaatagggtgtgaagtctccagctattattgtattggggcctatctccttctttagctctgataatatttgctttatacatctgaatgctccagtgttgagcacttatatatttaaaactgttatatcctcttgataaattgatttcttatcattacatagttaccttctttgttctcttacagcttttgtcttgaaatttattttgtctgatgtaagtacagcaacttctgcttttttgttttccattggcatggaatatctttttccatctctttattttctatgtatgtatttgtaggtgaaatgtgtttcttatagacagattaatgagacttgttttttcatccattcagttactctatatcttttgattggagattttagtccaactacctcaatgttattactgaaaagtaaggacttactcctgccattttattattctttttctggttgttctgtggtcctctcttctttctctctttcctgtcttcctctagtgaaggtgatttcctttttgtacttggatattgatatatttctgtaggtttcagaagttgcctgttattattcctttgaataaatttgctccctctatttatttatctacctcttctttaaggccaataattcttagattttcccttatgaaactattttctaaatcctgtaggcatgcttcattttgttattcttttttcttttgccttttctgactaggtattttcaaatagcctgtcttcaagctcactagttcttgcttctgcttaattctgctgttaaaggaacttgatgcattcttcattatgccaactgcattttttaactccagaatttctgcttgattctctttaattattttaatctgtttgtctgatagaattttgaatttcatctctgtgttatcatgaattttctttgagtttcctcaacctacctattttgaattctctgtctgaaagatcacatatctctgtttctccaggatttgtccctggaaacttatttagtgttcatttggtgagattaagttttcctggatggtgttgatgctagcagatgttcttcagtgtctgggcattgaaggattaggtatttattgtagtcttcactgtctgggcttatttgtactcatccttcttgggaaggttttccagatatttgaaaggacttgggtgttgtgatctaagctgtatctgctttaggggggaacccacatccagtaactctgtggttcttgcagactcataaaggcaaccccttgatggtcttgaatgagatctgagagaattctctggattaccaggcaaagactcttgccttcttcctttcttccaaatatatggagtccctgcctctgctctagccacctaatgctgaggactggagtgacacaagcccccttgtggccatcattaatgtaatttcactgggccagatctgaagctagcacagcactgagtctggctgaaggcttgctgtagccactccctgattactgcctatgtttcctgaaagcacttgggctctctaatcagctggtggaaaaaccaaccaggcttatgtccttccattcagggtagcaaggtcccccagacccccagtgggtccagaggtatcatcctggagtctgcccttttttaaattaaaaataagcaatcaagaacagcaacaacaaaaaattgccagagtaaacatcatctttatcttaagcaatgtcagagtggaacttaaaacttagaaactggaacttagaatgccttattgaaagaagaacacacatatggacttaaaatggtaccaacagagagaagaccaggaaaaaaaaattaagttcataaactactctttgcattttgcttttatttaagaattattccttgcttctttcaataaattttgattgtgtgagttttcaattctccagaaattgaaaataacataatgtgctcactattcatgattgcataataaaaccacttgggtattaaaaaaataataattccttagctagaggttactgaatgacaatagaaaaaagaagaaagaatctacataagtggagacagttctcactctaagctgctgaatatgctttctgtttaactaagtaaaaagaagtaatcaaaaaacaatttccacaattttttatgaccatattcacctacctgcctctgtatgtacatactgtgttctctctcttgttctgtagatgagccatccacatggcaagcaaagggcagtctctctactatgtcccagatctcattcattcttgcctagacaagagcaatttttctggaactctctcttttctctcttgcattcttttttttctcatgagcatattaaaatgctgctatttcactctcatttgaaagtaaatatagacatacacgtatgtgtatgcatatatgtgtgcatgtgacttcaccataccctccagttactgtcccatttttttctttatttgttttacagtaaacttctcagaagagttggctatattcattgatttcagtttctttacacttgaacctgtttctatcaggcctttgccaacactactccactgacgtagctgtagttaaagtcaccagtggcatactctttgctaaatcatgagattgatagtcatttaacctatttgggctatcggcagcatttgcatagctgatcactcccttctcctagatactttctttgcttggcttctaggacacaaattcctctgctttccttctccttcactggtctcttctcattctttttcatttattcctactcatctttcatatcttttggagctcagccctttgagattcattcgtaagtaagaacaatctatctcactgctttaatgttcatctagatgctcataacttctaatttgtatattcaagtgactgcagaacagagaagtaatctcaaaatatgcacctccaaacccaaatgcccgctattatttactactttgctataaccttttctatttccactccttattcaataagaagcagctcctttccataaggcagctccttatttttgattgtttgggccacaggccttggagtcacatttactctactttttctctcatctgctgtctaatctgttaataaatcctctaggttatgccttcagaatatttccagaacttttatcctctcactgctgcattgttgcctctgttactaaaatatgagttagaccatgcctctgtggtaatcaaagccttcagtggtttacttttaacccagagaaaaagtcggccatgaaaaacatgtacaatctgcctgctcctcctcctcccactccccactcttcacctgtatgatttctcttaattttcctcctatttacactttcacccagagtcttttcattttctcttccatctgtctgaatgttcttctttcagatatttgtctgtcattccccatttcctgcagatttgagtctccttccctgacaggcctccactaaccacataaaatttctaccttccaatttccttttctcttcctcttctacacttttctccttaccatttaccactatctaacaagcaattttaactttattcactttacaaggagttctgactgttttacccactgacatatccctagcactgagcttgtggcacattttaggtacacaataaatatttattgcatattgccatattagaattactgatgaagacccaggaggctgtctttaaaggaagggattttttaaaatgaaaatgttagaaaaggtttcgaagaacaagttgcatttgaattgaggttagattaaatgataggtaatatttgagtgtgtggatgagggaaaggtacctgtggtggtgattactgagtgtgaaaagccaacgatcctcgaaaataagacatctaccaagaacaccgtctttcaatttgggtggaatttggaaggcttgaaaagaagatatgttcaagttactgggaggtaacttgggatgtataagataagcagaaagcctatttgggtcactgaggttaagcaatgaatttcttccctttcttgagcaaacaggcagatccttgatatgttacatttagatatgtgcagtagctttaatatcttcttccagaattcttccagtgacagtctttctgcttatcaagctggctaagggaaatcaaatcaacaaacctcatttcttattgaggtgggccagatacttattcatgcatatttagggaatataaatctcagttccagaatgttcgaactatagactattctgcataagccagaacataattataaacatgtagaaagaaaccactttactccaaaggtgtataatctatacatattttaatagaatttctcttttatacttgggacctaaatttgagtttagaaaaagcaatcagtaaacttacataatgagatttaagaggaaatagtcaagcaggaaattcctctcccgagcaataatttttctacttctcaatctgcacctctttttttcctgcctgactcaaaatagcaaaattctagccttaattctccaggacccctgaaggcattctcttctaatacggtgttttttccttttggttcatcttccatagctgttttgagatcagaggccttggcttccatcaccgcctggaactgacttccctcaccacttttaaaaatcagagataaatagtgaattataaaaatatgagtaaagtcaaaagcaaacactggaaacatgatcaaatacaacaagaacatcaagtgaagtacttcaaatagcacttcaggtctgtatatgtgattagatgagtttatttttagaataatatattcattgaccgggcatgtgttggcctgtcacatgctatagattattagactgacaataacccctatgacttaaggatattattagtgttagctttcaattctacttatataattattaatgattattactgtaattataaataattatttattgagcacctactatatgttaaccacttaatatgaattatcagatgtaatcttcacaacagccctcttagttaggatatattataatttccatttgacaaatgaaggaagtaaggcaaagtgatgttaagttacctgcccaagatcacaaagcaagaggtgtcagacccagaattcgaaggccatctgatcactacagcctgatttcagagtgtagagttttaactattccacaattctgcttactttcagtaatatacaacttcttcagttattaagaagtaaaagtgagagctagctttaatcaggtgcctatacaccagacaccttgcattatttcctttaatctttgcaacagttctacaaattagaattttataggtgagaaagaggttaatttagttgcccaaggtcgttctctccaaaaataaagttctattttccttaaaaacatattggaagattgtcatgaggtcaataatgttcagcaggcatacttctgcaaaatcataaaactcatcttatttacttagtaaaaccatggctaaattaagaaagagataaataaaggtgcattccattatttttcccactttcaaggtccagctcaaatgctgtattttctaggtctagttccttcattaagccttcctcaattccctgatccccaaaaccaactaatcttatatttcaattcaattaaggagaagcaagtctaatggattgggaacagatgtgcatatttttaaactgctgttgcttactgtggaagtcagacctattaaaccctccattttaaaaacctttaccctttacattctgattattttatggtacatattctgcttagtagtagtgttattgtgttgttcttattctgtcttccaaatgataagcagatgataagcaaagacttttatattcattcattcttatatcttctgtagtgtttaatacagtgcctagcatactgtatatggtcaaaaatggttataatattgatgtcagtggataattcaatgatcccacctttgattagcaattttttaatttaataatctttaaatgcctagaattaatagcaccattctctcagcttctatacccaggataatttctggacacttctgatgactttcccatgatctccggaaataataaaagataagctttacagatgaggtaacagatttgcaaaatattaaatatgccattacctgaagagggcgtaagttgagccctttccttcatctctttcttgctcacagatattacaatatctgtgcaaaaatcctaatgcaagaatgagcttagcatattccagggactgtcattaactgaaatacatatataacaaggaggaaaagatacaataaatgtggaatttattctaattacaatggaaagcaagtggagagttttaagtaataagttttatgctttaaatttttttggctgctgcatggaaaagttccttgaaggagaaaatgtgaatagagagtggtgggaatggcagaggactattgcaagagtccagttggttgctgatgttatcttggactagggttatccgtgtggaaatggtaagacaaggtaatattcagacttgccagtgtactacctgtgggtgtgaatgacaaatgtgagattcaaacccaggtctatattgcactaaagtttacaacatttgcacacctctatattccctcaattgggtatcttgtttactttttaaaaaaagacaatataaaacttataagcctagtttttcttcaggttactttgttgctttctgatttaccattcttatcgccctaaaatctaaatgtaattttagagaatatagttatacattgaaaatataagagcatgcatgggtacatggaaattaagtatcttgagagattatatctattctcaaatttacccttgacaatgcaagcagttacaccaaagagatgaaccaattactgtaaacaagacagaaagcacgtaatctttatcttttttctttgtataaataacttgcagcattccagacgtctctctcattgcaaattgatataaccacaaaaggattttgagtataatttcaaggaacatttgtttgcgatcatgcttcccacctcccaccaaaaataataataaagatcatggctagaactaacgctccaagaggtacttttaaccttaaggaagtgtagactttaaaatctattagtgaggcaaaacaaactttgtttcagctagtgctagagaaatcagacccctaccactagagaactataatgcccattaaaaataaaaattaaacacaaattgtgacattaaaaaatatgagtgcctgggtctcatttccaaaggttctagttcaactggtttgagatgaaactcacgaagcagtatttaaatttttttctcagatgattttaatgtacaaataagattgatgagaacagggcttgaggaaaataaattatgttgtcttttttttataatatcttaggatgggaattcatcctcattttccaagttaaaataactgtcttgctctggcaaaactcagacagaactcatggaaaatacaaagttttcatctgtgtgtgtgtgtgtgtgtgtgtgtgtgtgtgtgcatgcacccagaaacacacatgtaagcacacatgtagcaatggtttaaaagaggacttttagagctctacagtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataagagcattacatagttaggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaatagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattcttatttgtattctcatatttaagagtaaaggccaggcacagtggctcatgcctgtaatcccagcactttgggaggccgaggcgggtggatcacctgaggtcaggagttcaagaccaggctggccaacatggtgaaaccccgtttctactaaaaatataaaaactagccgggtgtggtggtggacacctgcaatcccagctacttgggaggctgaggcaggagaattgcttgaatccaggagacggaggttgcagtgagccaacacagtgccactgcactccagcctcggcaacacagtgagactctgtctcaaataaataaataaataaagaccctaagacaaaaaagaaagataactatctgcagtctagagatgaaaccaccttaacagttttaattatattaggttgcattttcaagtgtcagattgtcccaattcatacagtacttttactagttctcagaatgatctgtatagacagtaccatactgtgtcagttccctggcatgggataggatgtagtgaaaaaaaaatcatggaagagaaaataaattattcaagctccagttactaaattccccagtcacttaaccttttggagaatcaattttaacatcggtaaatgtaaggatcactatgaatgctttacctatctcatagatcagttgggaaagtccaatataagaaacatagatctgaaagtggctaagtgatgtgtaaaataatagtttttctattttgcaatgtataatcatggtgggtctaggattgagtctgacactgtccaaatcaaagttctccacttttctctggattacatcctctgctttttcttctggaaatttggtgtattatgattctcctaaattttcaatttctcaatttctaatggctatttatcatcagcatttaaacataatcctaaatttactgtcttaaaaaagagtctttaataattataatcctttttggctatcagcatctctctcctcccttttagagctaaactttcacaaagttgtctatcccaactttcttcatttttatgttcctttccccttccacctcaagcaatgtgaattccaacataaccatctataaaaacagaaatttctctcaaaaattaccactttctgaaggctacatcttctttaactttttattttacattgtttaccaattccttcttcctgaaacacttttgtgggggataagtgtcttccatgaaactgcattttgctacttttctttctgcctttttatctgtttgtctcggtctttttagaagcctccttctcttctgtttatcccttaaagattgacattcttcagaacttaccataggatcttcatgctcttcacctttactttcctcactattaaaatcacatctatttgcatggttttaatacacagcatgctctttcattcatctcagtttattttctcctggacttcagatgcatgggcatatccaattgcttattggatatcttcactccaatgtttcacatgcaattcggactcatcattgttctccactgcctacctcttgtctctctgtcttaatgaatgacatcataatcttctcagtgactgatgccaaatctgagttttatcttagatttctcccttccctcaacttccacaacaaattaataatgtgtcttgccaatcctacttcttaaatatctctcaaacacatcttcatcttttgatcacatcaccaccattttggtcacaactatgtctcatctaaaatactgaaaatattatccaacctatggtagcacaaaagactgactgcagtgtgtttcatggggatgttttggcatcctcattatattaattatctatcgccatataacaaactgacacaaacttagtgccttaaaacaacacagactcctactttacacttactgtgtatgtaagaattgggtatggtttagctgagttccctgctacaggatctctcacaatgctaaaatctagacgtcttatctcaaaactcacccggggaaggatctacttgtaagatgatgtagttgttggcagaattccttttgggttgatgcactgaggaccttagtttcttgatggctgctagtcagaggaagccctttatatcttgtcatgtgagcccctccataatgcagcgtgcaacatggtggcttgttttatcagaactaacaagggatagagtttgatagcaagcccgaggtcagaatcttatgtaactgattcacaaaaatgacatcccatcatctttgaaatattttattggctagaagcaggttatagaccctgtgcacacacaagaggaagacgctgcacacgaggataaataccaagaggcagaaatcaccggaggccatcttggaattgatctgccagatttcattattcctttctgcttcttaaacttcccacagcagcaaacaatgtaggtaaacattgttgcagtctacacagatgcagttttaaggaaaatccctgaggatgcagaggtaggtaataagaccctctcgtgtacttccttattatcctttatttctccttacatagccctacattgtattataattgttgtctcacatgtatattagatagagaccttggttatcatattcatcacaagtgcccagcacagagtctgctgtatagtaagtgttcaaaaaatatttcttacataaataaccccaactaaataaaatgctatgtggcatttttgctctctgtggtttacattcaaaagattgatagatccctcaaatgaataaccttaataaaacaatactgtctttatcaccactgaatttatctaaatccctctagaattatttatggtttttgcttctatcctccccagggttaatgggtactattccttaataactccatctatttgctctaaaattacctctttcttgactcaagaagatactcaatttctgcattctgatttttcaataattaattctatatttatacttctgtacccatcacaaggttgaacattacaatccaaacacttcctgattaaaatgtttcagccttattcttctgttttcatgtagaaaatgcccaatccctttggtaagttgcctggatcttctccaactgcatatcttctttagggtacaatgatcagcacttcacagttttgtttaaggaaagataaaattcgtaatgctaagttgagatacaaaaataaagatggtgccatttctcctagatctttataataaccttagttgtaaggtaaattagtggctgggctggcatgaagtctgaaatattggtttggatgcattgaatgctaatggaaaaacctgctccaggtagagttttgtgatagagtttatcttctgtgaactttattactcttttgttaacttccatttgtccataatatagtccctccctgaaggttccaaggtgcatcagaccttttttaaagtaccttatgactactaaccaaatgataaaaaactaagttggaaaatgggattggaaccagttacaggggaacatagatcccagctatgccatttgacccagtgctgataataaaaaaagacataataccaaactctgtaatcctgaatgttgaaatcccaaaagattaaattccttaaatctgaaatctataacatctaaaatccagaaaatcaccatctcggaagattaaaatcacaaatattgaaatcctgaaagccaaattctatggaaggcattagtgcattttcagttgcacacaggatagttgcatcatgttagttgcataatgttaggtgggacaataatattaccttgttattgtctttatttggaaattaagtatgatttaaggagacatgtatgggtgccaagttgacaaggagtgaacttgtggacttaattgtctgggtcaacttgactagattaaggaataccaagaaacctggtgaagtattattttgggtgtgtctgtgagagtgtttccagaggagatcagtgtgtgagtctgagcagactaggtagggaagatccgctctaatttgtttcatgcatgttttgcaaatttgattccacgaaagtgaattattacaatgtttactttttgtgtaagcaccatccaactggctgagggcctagagagaacaaatacagaagacaaactgatctctgagagctggggcaaatttttctttagcttcctaggatgtcagaactttgggctcaccggcctttgaactccaggacttacaccagtcctcccaaccaggtcctgaaactttcaatgctgaactgagaattacaccattggctttcttgtttctgaagatttcgaattttgattgaaccatactgctggcatccctgggtcttcatcttgcagacagcctgtagtgagacttctcagcctccataatcacattagccaattactataatgaagtccttctcatgtatctatatatcatcttggttctgtctctctggagaagcctgatgaatactgatttggtatttaggaaatcaaatattattccttcttactgtattttatttcttacaacataatagaagagatttgtgaaattgtttcctcacaaggaagctgtaatacaataaatgcatgaggctactcaatggtgaaacacaaaatttaaaagctaattgttattggtgctgcaaaagcagaaaatcacttagttacaatagctgagcaataaccagcccaaaaatggacagcatatacttacaaaatttgtagaccacaaccacactccaaataccagtgcagcaagtgttttgaagatcccagaagtgaaaattcaggtgaaaaagacaagaaatccctgccaaacaatttaatctgtatgacttccgctcctttacacaaaattgttgttatatatttcattttagcatcattttcaatactggaatttaaaattgtataaataattttaaagagctctaatttgtttcatgcatgttttgcaaatttgattccacgaaagtgaattatcacaatgtttactttttgtgtaagaattttgcatatatgtaaaaacactgaaaacttcttcagtaaatgaaggaaggttcttcttttatatctgcagcttttgtgaaagataagatttctctttgggcaactgcacatgccgtggtgacccatggcagtttttgatggatctcatcaaaactcaggttgcttgtcgtaatatttcacatgaaaatggttacaaactggatgcatgcaattactaaccatagtcatatatgtttatacattttggtttcagacttatgtcatatgaatacagctcattttctcataactgttatatcagtgtgactatcattagtttccctgagtgtttatgcttgtgaaaatgttttattattgcctactttattgtgtaaagtggcccataaagtgttctgtcatgtttttatatgtttcttaagtaaatattcttttaaaaatgagatacattatattttaaggaattaaaaaatttgtttttagaattatgttttccagattttgatctctcaggatttcaacaatcaggattatgccttatggattatggctaaaatctgttttggtttaatcccataggctgtgaggagccattgagagttttggtgcagaggaatcacatgatgaaaactgagcatagaaaggatgaaaaatgcatttagagattgtcactataatttcaggaagaagtaaagaggctgaagaataatgatgatgttgacaatgttttaaaaagtataaatatggccaggcacggtggctcatgcctgtaatgccagcagtgagaccccacctctacaaaaaataaaaagtgcagtggttcatgtctgtagtaccagccactcaggaagctgaggtggtaggattgcttaagcctaggaggttgaggctacagtgagtcatgatcatgcaactgtactccagcctagacaaaagagcaagactctgtcaaaaaaaaaaaaaaaaaaaaaaaaaaagggtacaaaaatgttatagtatgaacgtattgggagaaaggacattcatattggcttacagattttgaacctggataaaaatgtatccttagatagaagtaataagttctagtgtttgatagcacattagagttttgatgagatccatcaaaaactgctgtagttcatcactgcatatgcagttgcccaaagagacaagatcctgagaaatcttatctttcacaaatgctgcagatgtaaaagaacctttcttcatttattaaagaagtttcaatgtttttacatataggcataatgcttacacaaaaagtaaacattgagctaatgcactttcatggaatcaaatttgcaaaacatgcataaagcaaattataactctttaaaattctttacacaattttaaattccagtattgaaaatgatgctaaaatgaagtacataatagcaattttgtgctatgtgtagaggagcagaagtcatacaagattaaattattatttatttatttatttattattttttgagatggagtctttctctgtcacccaggctagagagtgcagtggcgtgatctcggctcactgcaacctctgcctcccaggttcaaacgattctcctgcctcagcttcacgagtagctgggactaaaggcgcacgctaccacacccagctaattttttgtatttttagtagagatggggtttcaccgtgttagccaggacggttttggtctcctgacctcatgatgcaccagcctcggcctcccaaagtgctgggattacaggcatgagccaccacgcctggccaagcttaaattattgaattaagaaattacaacagggaaataatgacagagaaaactagaggaataattagcatattatttaaatctatgcaaataagatttaaagca

SEQ ID NO: 867 - DNA, 66289 bp, Homo sapiens
attgaatgcatgctattttgacgtaatgtcactgaagagacaggagtttgattctacactgaaacgtcaactcaaatttcaatcattgttataaatttgtgcaatttatttgcattttttttctaaatttcaggaagtgctaaaagcaaatggggcaaaattatgtagtaaatccacaagttttgtgctctcctaactgcattgtgcattgtagcaataaaaaatatttaaagagaaaaccaaaagaacaaacaataccctagaaaaagataaactttttaaaaagctgaaaattgaatataaaatacaaagaagctaagacaatgaagttaaagattgccgaatgtcaggtttgggagaacactgtagcagactgaggttcagtttcagaggattaacacggaccaaaagtgttcctatgcctggagtttaatttagattcattgcttaaagaaagaaactaagaacaaatgctgctgatggctacctgtggcaaggactcataggatcgtgtgggctgaagagatgggaaaatataaacacagcctcacagaagaaataaactaagtttgaatctgtaactggctggatccacaatatccacaaagcagaaaagccaaaatgagagacctgattccagatgctgattctactggaacatgttcaaacaagcctctatatagaagatcacatggaaggacggagggagataagagaaaaaagaaaggaaacagagagagagaaagagagggatccttttcaatcaaatgagtctgcaaacacaaatcctgaattgcctgaagaaagatgcacacaaacaaaaatcaacaattagaacattaattcattccatatgaaattgattataaatgtttcataaacatattaaatatatttaagttgctttaaaggataaattaagatttggcattgataaacaatttttaaaaagaaataaaaaaaacagagaaaatgtgtataaaatagtacaggtgcatatgaaaagaacctactagaaatcctggggaaaatatagtcattataataaaaactctgttagaataatggcccccaatgaatcacaaccttcttattttacattcttttatagtatgagtttcccatttcttcacctctttaattcagcatggctttgagatttgcatagactgacagaatatgacaagaatgatattatgtgactttttatgctaggccttaagagaccttgaacttccgccttttctgtcttggaatgaatcttttgtctcgtgaataagcaactctgggctcctatgagatgagaggccacatagaagagaagtaaaaagctacagacaagagccaacaccaaccaccagacatataattgaggttaccctgaaataaacaccccagttaaggttcagataactgaagccatatatgagtaatcctaggcaagatcagcataagaactacttagataagctcaacacaagttaaataaatatatacttgttttcagacactaaatttggaatgatttgttacacagaaattaataattaatacaaacattggcaactagaaacaaggtgctgccataacaaaatcctaaaagctaggcattggctttgggaccatgtagtaggtggtctatagaaattgctatttatgtctgaaaatgtggggatcaaaactattggcaaaacttaagacttaaatagattaaaaaaatgtatgcaatgaatgtgtagatatagccaaggtgatatcccgacagaacaatgaaattgacagttggctttttgtatctgtctataataaataggagaggaggagatgaaccaaagggagtatgattcatttggaaagcagaatttagaggaaatataaaggttcaagatgtgctgggttagaaaataaaatcatttcatatttctagactttctagctgtggtcttagaataaaaatcaaaccaagtgtgtggtgataaaacctttagttaagcacacagagaaatttatgatagtgatcagtaaatccttgcaattaggcaaagaacttctatgagtttcaagggtattatctcacaaacaccttacaaatggcccaatgtaagtagaggtttatttgttaaatagttatggatgtggcttttgaacacggagggaatctcaattagattcacaaaaaattcaaaatatttaaggtagttataatgtctcatccataggaaatagagacagtttataatgaaaagaagactctgggaccccaaatctctgtggtcaggaagcagactgggaatcccctttagttgcaaacacagtccatttattatagaaaatgaaacaaatcttagagcgtggagaccagttacctggaaggcaaagtcaagaactaaggagatcaatagttaggaaactattcagccgaggaataattgggcccttactaggatgtgttttcttactatggagaagaagactcttacaacgtatacatgtctatatttcagaatttgtaagaaccagtgacttctatatgcctaattccatttcttctctctttttttttaattggaagtgtctattgcaattattctttccctgtcttatcagcacatgttgggtatattgggtgttgataatttattatttgttatttacagttttattgaggtatacataaaaataaaaattgtgtatatttatggtgtatagcataatgttttgatatatacactgtgaaatgattatcaaaatcaagctaattaatatatgcatcagctgacatagttatgctttgtttcattgtgtttttttttttctggtgaaaacacttaagatcaattctcttagcaaatttaagtataaatacagaattgttaactatggtctccatgctgtacattagagctctagaactcattcatcccacataaccgaacttttgtaccctctgactgatattttatttccttccattctacccttgtcaacaggagttctggagggaacaaatattcagaccatagcaaaaggcatagaatataagaatgtaattgtgcacagaaattaataaaacatatttattgcttgatagtctacgtcctatatgcttgatagtctacatcctactcaggaatgcctgtagctagtgaccaattattattgcaatacaaaactcagctcctttgcttcaagtcacgatacacttagaagtataatttatgctccagagtttctcaaatgattaagcattcttggatgccaccaaaattgtatcttttctgggcttcttacctacccttccttttcctgcttccctcactcttacttgtttcttctggtagtacttgctcagtaaataacttgcacctaaatctttgactcatcatctacatctgtaagaacctgtcctaaaataaacatattagtttaagaaataactggaatttttactgacgcctagaatgtggaaacttggaaagagtattactcctacattaataacagtaaaatgtcagtttaaattttaaaaattataacttttcttgaatctgtcagagaactaaggtcttggggaaaccaattagcttggaattcaaggaaagtcaggtgtctccaagcagatgagatagacacactgaaacacatatggcagagaacaggaggaaaatacatcactgtcttgtaagtggttaaaaagaatttatcaatttttttttttcgagacagagtctcgctctgtcgcccaggctggagtgcagtggcgcgatctcggctcactgcaaactccgcctcccgggttcacgccattctcctgcctcagcctccggagtagctaggactacaggcgcccgccaccaggcccggctaattttttgtatttttagtagagacggggtttcaccatattagccaggatggtctcgatctcctgacctcgtgatccgcccgcctcggcctcccagaatgctgggattacaggcgggagccaccgtgcccggcagaatttatcaattttttttatctgaaaaagctcaagtatgggctagcataagagtatagaaccgctgggaggcatggatatcaggggtcttcataatacttgcaggctattctccacagacttctaatgggagcatgattggatacagaaatcctctaacagtggtgcagacttggataaggagagcattcatcgctacacaaacaagcataaatccccatgtaagaccttctcctctatggaacaaaagccttaaattgctggggtaagggcagcacaaaccatcacccccagggcacagatgaagatgaagctagggaaggtacaagaaaaaaacaaaatatctatccctgaggtaggggtaggaaactgtcctggaccaagttcattatatgtctcctaccactaggggaggggcagggaagtctcccatacaagacctagtaaagattcacagcaaaatttggcttctatcggcagatttactaagaaaatatcaacattaagaccaagcttgcctaagttttgaaatggtacaaaaataagaaaaaaatccttttgccccctaacaccaagatcacgaacaccaagtaataagcactaacagtctactactggagagaataagaacatgacaagatccgttgtcaggtgcaagagcaaaagggaaggccaaatgttgagggtagataagggacattaagaaaaacactctggtaatctgattttcaccctacggtattgctaaaagaattttaaactggttgtacactgaaggtaaccatagtaacagcaaaatcccaaatcagctaaactcatgactaggttgactccagtctccacataaacacactggcagaagagatgtgcatctttctttcatttttctttatctttttctttttcttttttctttttctttttcttttttttttttgagacagggtcttgttctattgcctaggctggagtgcagtagcatgatctcagctcactgcagcctcaacctcctgggctcaaacaatcttctcactttagcctcccaagaagctgggactacaggtgtataccaacatgcctggctaatttttgtattttttgtagagacgagattttgccatgttgcccagtctggtgttgaactcctgggctcaagggatccacctgctttgacttccccaaacagtgggattataggcgtgagccatagtgcctggctgcgatgtgcatatttctatgcaaaaatgctatttacttcagtctcgactgtacttttccttcatgtctaggattcagtattaaaacagaaaaaaataaggaaaaaataacccacttagaaaaagcaatcatatcaattagagtcagaaaagaccccgatgttaaaattatcagggaataaatttaaaactatgactaacagtttaaaagttttaaagcatagtttcctcatcttcaaaataattttttaaagtgtcaagtgtcaaattcttatggttattgtgcatattaaatcacataatgttagtgaagtgcatacttaacaaaatatctgacacagggtaaggatttagtaaatgacagtagttgtagtcattattacctgcaatacttaataaaatatggttgactgtccaaatgtgtttgtgataaacttggtttgaataattcctattaattatgcctttctagaaacttttgcaacaataaaataaatgctgcaagggctgattggttttatttcagatgttcctaagcatatctttaagccttaccctacccactccaagctgatttccatcactccccacctccttgctccttgcttcctttgccttaactatattttttgttgttgttattgttgttgttgtttaatcaggactaggagatgaaaggcagctgaacttcgttttcctctgtgatagaaactttgatattggtaactatttcagctctctattcaagaacactggaaagtttctggtcacaaaaaaatgtcagtgacttcactgtagtctgtaccttttttcttattgtagaactcaaaattctaattttccacttattattttatttatctctatcataaagccaaatattccaattaacaccacatagtaatttaaagtactattggaatatactttaaaattattcctatttcccttgaattttgtattgtttatgtaagtaaaattcaattataagtccatattcatatactaatcagtgatatccagttgtaatgataaatgttgtttctaaaactcttttatcattcaaggggcagaaactggattacagaatccatctcctttacccaacttttcagagttttcagctcccttttatttttatgtatcttgagttatttcttctgatagattctgtgccttgaaataatcttcaactaataaaatatttagaatttaggcaatagaatgtgtctatctgtttcaatcatagactctcctctccttgtaaccagactatatttatagtatgaatattattggccagctacccataaccaacacagatttttagtatatctaataccatcatggttgctgtagttctttcaaaatgatgtatcaaaattaaagttaatgacaagtacaatgtaaaagtaaggctgcaaggtatctctgtatttagctgccctgtgttgggatatctactattggaatcttgacagcaaattttactgctcattgaagattattccacatgcacttaagtttctctagctaattcattatagttcctcattaaattataattacttttaaaaataataattattttaagaaggtgaatccaagagctgttgatatcatgtggcttattttccccatttggtgaatgtattagttcgttttcatgctactgataaagacatactcaaagctgggaacaaaaagaagtttcattggacttacagttccacatggctggggagacctcagagtcatggtgggaggcaaaaggtacttcttacatggtgtcagcaagagaaaatgaggaagaagcaaaagcgaaaacccctgatgaacccatcagatttcgtgagacttattcactatcatgagaatagtgcaggaaagactggcccccatgattcaattacctccccctaggtccctcccacaacacatgggaattctggaagacacaattcagttgcgatttgaatgggaacacagacaaaccatatcattccaccccagcccctccaaatcacatgtcctcacatttcaaaaccaatcatgccttcccaacagtcccccaaagtcttaactcatttcagaattaacccaaaagtccacagtctgaagtctaatctgagacaaggcaagccccttcaacctatgagcctgtaaaatcaaaacaagctagttacttcctacatacaataggggtacaggtattgggcaaatacagccattccatatgggagaaattggccaaaacaaaggggttacagggcccatgcaagtccgaaatccagtggggcaaattttaaagcatcaaaataatctcctttgactctaggtctcacatccaggtcatgctgatgcaacaggtgcattcccatagtcttgggctgctctgctcctgtggctttttcaggatatagcctcccacccagctgctttaatgggctggtgttgagtgcctgtggcttttccaggttaacagtgcaagctgtttgtggggtctggagggtggtggccctcttctcacagctccactagtccagtagggtatctgtgtgggagctccaaccccatatttcccttccatactgccctagtagaggttctccatgagtgctccacccctgcagcacacttctgcctgtgtgtccaggtgtttccatacatcttctgaaacctaggcagaagttcccaaacctcaattcttgacttctgtgcatccacaggatcaacaccacgtggaacatgtcaaggcttggggcttccaccctcttaaacccaagctgtacgttcgttggcccctttcagccacagctggagtggctgggacacaaggcaccaagttcctaggctgcacacagcacagggaccttgggcccagcccacaaaaccactttttcctcctgggcctctgggcctgtgatggaaggggctgccatgatggtctctgacatggtctggagacattttccccatggtcttggggattaacattaggctccttgccacttatgcaaatttctgcatctggcttgaatttctcctcaaaaaatgagtttttttttttctactgcatcatcattctggaaattttctgaacttttatgctcagtttcccttttttttttttttgagatgaagtcttgctctgttgcccaggctgcagtgcagtgacatgatcttggctcactgtaacctccacctcccaggtttaagcgattctcctgcctcagcctccgaagtggctgggactataggcacgtgccaccacacctagctaattttttgtatttttagtagagacggggtttcaccatgttagccaggatgatctcgatcttctaacctcatggtctgcccgccttggcgtcccaaatgctgggattacaggcatgagctgcgactggccccatttccattttaaaattgaatgcttttaacagtacccaagtaacctcttgaatgctttgctgcttagaaatttcttccaccagataccctaaatcatctgtctcaagttcaatgttccacaaatctctagagtaggggcagaatgctgccagtctctttgttaaaacagtaagagtcacctttgctccagttcccaacaagttcctcatctccatctgacaccacctcaatctggaccttatttttcatatctctatcagcatttttgtcaaagccattcaacaaatctctaggaggttccaaactttcccacattttcttgtcttcttctgagccctcaaaaatgttctaacctctgccagttactcagttccaaagtcgcttccccattttcaggtatcttttcagcaacaccccacactactggtactaatttactgtattagttcattttcatgctgttgataaagacatacccgaaactgggaacaaaaagaggtttcattagacttacagttccacatggctggggaggcctcagaataatggcaagaggcaaaaggcacttcttacatggcagcagcaagagaaaatgaggaagaagcaaaagcagaaacccccataaacccatcagatctcatgagacttattaactatcatgagaatagcatgggaaagaccgaccgtcatgattcaattacctccccctaggtcccgcccacaacatgtgggaattctgggagatataattaggttgagatttgaatgggaacacagccaaaccatatcagtgagcccccacatcagtggcaaagttaggattgcaagcccaggtcatgtgactccagagtccattctcttaactactctgctatgctgtctcttacaatactttctaggccgtctaactgccactaattgtatgacctttggaaagacccttaaattatcaggaccactgctttcacatatgagaaatggggataataataaaaattattacagtgctgttttgagcattaaatgagttaatgtttgaaagcacttataagtgtttgacacactataagcactgtaaaggtgttggctaaaatgagttcttttaaatattaccttacaattatcttattggtatcagttaacgtttttataagtagattaaaagtttgtacaatttataattaaataaaagaataattgttagtccgtggctggaataagttaggactttgacattaaaaccccttatagttgtgtaattacttgcctgacaatactgagtaagcatgtggctactcaaatcctttataaaagaaattctcgtaatttagtgatattacttatgataggtagcattcactaggaatttagtatgcttcacaagctattcctaatactaaagtattaattctaattaccagaataattccatggaataggtactactattatcaccattttagagataagaaaaataaagcacagagaagtagctccaaattcatagagtaactggtagagatgagacggaagaatttatcatgtcctaagcacttccaatttagccagttttccactcttttcttctcccagcatcgtaaaatctgactgataagtataaataaggaagaaaaaataacatttattctctacaatatagtctcctcactacctgatgctaaatatgaagggacagttctaatgaaagtgatcaacaagttctagaaggaactaaagcttagttccttcctcaacctcagtgaaaagaacaaggttattagtggcgatgtttttcctaggtgtgggggagctaagcattttgaacacagcaaagataaggaagtcggtctgtaatctgcaaaaaggtaagacatttattaaagcattaatcttacctagactggcttggattttcacagtgatctcttgctcatcatgcattttaacaccccttgccacacaaccacttctaaattcttcctctaaaggtaaagagctgtatgttctgagagtaaggaggaaattcctaaaaaagtatctagaatctagaaaattattctctaggtttatgcctcatacatgattgcaaaccatagtgatgatgagcatgtttgtagaactgactttaatggtcttctacaacaattcaggctacatctgcccagagagtgtgtgtggtccacatgttctttcaaatggagaggacctaatcattaagacatagcttttttttttttttcttaactttcaggagtcagatgtggaggatatagagagaattttgacttttagtccatgttgttttccctgacacattttcaattacattgacaactaaaaaacaagaccttggcaagaacatcagggagaaatggtgatgagatgaaaagatgctcagataggcagattttgatatatgactggtcaacagaccttgggaggctctctctacaatgagaacagaagcatccttgtgctaaaggctcatctgcttacaacggttgagataaagaggaatttctcgagctagtggaagaaacaggatgagaagtgtgaaaggaaattaaattttgggattcaaaactcatttagccaaagggaaaagtcaagctgtgaactggatcatgcaaacctgcctccacctttcagttcctaaataaaatggctacaagatgcaaagctactcacctttcccatattttgccaacaaggaaattcctgatgagctgttaaaacttcaccatggcaatgctaattgatagcttatctttataggtgcagtcactcagcctgccagacacaaatgcatatcagattgttcccctaccccattttatttgtgtaatgtaaaatgcagatttcccacatttttcctttgccccttttaagtgaaaactgtgtgcttctcaatatcctgccctttcccctttaaatttggagccctcaaaatcatcttaagagaaaggcatagacctgactcctgggcgtgtccttaactttggcaaataaatctccaaaaatgattaagacttgtcttgtcattttcttcgattcacagaaggcaggatatacaagtagaaagcagaaggcaggatgtacaagacatcactctaaaacctttgaatcaacaaatgaatagcagaaaagcagatgccttgacattgtccttttaaatacacggactcaacaaatatcattgccagctcctaatatgttaggccttgctgatacattggttgactagaaagagtttcctgtcccaatggagctgatattgcagaaaaaagtaaattgtacaattaattacaaatgtgttgaatgctttgaagaagtatagatcattttgagagcctccataatggaaaatttaacctagcttagtcaaacaacacagaaaaaggcatttaatctaaggcttcaagcatgggtagacttcagcttttcaatgtgggcaaaccgatatagagaattcaggcagtgacaaaaaaaaaaaaaaagtagccttaatgtctcactcacaaagctaaatttatggttgaaaatgttaatctatcttctctcatccagaaccaaataaggattgaaaatgtatattttcagaaggattatgttaatgaatatttattgcatgctcttcctgtgccaccaaaacgctaaactctttatattcaacacattatttaatccaagcagtagcctatgtggaatgtgctatcattccttccattttacacatgaggaaactaaacatcaaagcatttacactgtatatatatgataaatccaggaattcaaataaaggtctccctagcacacataccaaactccttccacaatgcttttccacatttattagaagaaaacaggaacaaaaaaagcagtactcaataaaagcaaaataagttaccctggtgaaaaggaatgctgggaggaatgcttttggctatttataatcatacctacatcctcaaaaatccattgccagagtctatttccctgtttaacaatttgtgaggatccttagagaatcaacagcaggaggcaccactgttcagcccattagatatgatccaagatttgtctcagtgcctgactcttctgttctctagtaaggggtctatcaaaacccaatgtacttcatttttagcagaaaggacacatttcccaggggaaattgaaggtgatccttctcaaagtacaaatctagctgttttttgagatgcgatatatcgatgtctggatgaccatattgtgcaagacaattctcttcaggcccaaagttcttttcatatttacaataaaggaatgctatacagaaaaattttcacaaagatcaaaacaattcaaatagattatgccacacaatttcagtgaaaagaaagcttcaacatttacccaaagcatcatcagaaaaccacacttgctagaagacttaatgtctctcatatcacccacagagacatgagtgagtgatcattcccagaacgtgctattcaaagaaaatccattcatcttgttactagttgtcaacttcatgttttaaatctcatttcaatcacacaagaataagacattttctacacctcttagtcaatgaaagagaaatcaatacatgctttttaaaccaaaaatttatatcttcattactgagagaagtcaaaaacagaattatcttaacagtaatagtggtatataacacctctcctttttatttgtttgtgattcttttgttttcttacatagcatataaacagcttagtttatttttccttctactaagtcttcataatcatctcccttagactgagttccaaactctttggaaactactgatgcgttaattggctttttaaattatcttaaaaatataaactttattaattaccacatatgttctttcttttaaatattaatgacttggccaggtgccgtggctcacacctgtaatcccagcaatttgggaggccgaagggggtggatcacgaggtcaggaggtcgagatcagtcaagccaacatagttaaacccatctgtactaaaaatacaaaaaattagccggttatggtggtatacacctgtaatcccagctatttgggaggctgaggcaggaggatcgcatgaacctgggaagcagaggttgcagtgagcagagatcacgccattgcactccagcctgggtgacagtgtgagactctgtctcaaaaaaaaaaaaaaaaaaaaaaaaaatatatatatatatatatgtgactcttcatcaagtagtttctatgaataaaatcagatttcacaaactctgtaaagtgggagaatgaaaatctagtaggttttacttatctgccacaactaaaaattagtatagatttgaggaaatgtcattttgttttgaagagtgtgatttaaaaaaaaatatatatatataatatatatatatataatcttaatttgctttgtcactcatataaaggaaaccgtagttgagttgtagacaatgaggaaacacttgaggcttccgctgtatgtttctttgttattgttatgttgttacccagtaacttgaatattgtttaaagtgttgtaagacattgtagagtttatctcaagctgttaaaaatggtaatgtacaaatgtgaatagacacttatctatataatatgggtaagttttgttttgcctataatagatgtttataaaacaagtgagggagcagttggtatttttatttccttttctttctttctttttattgaaaaatcaagattgtataaaccaaaagctgcaagatgccaaaatcttgtagatgtcaaataaaaagttattttactaaaaaaaaagtgtgcgttggtaatcactactattaataattttaaaaaggataaataaggtcatataaccctgtctctggttcagcaatttggaaaagttgtagttagaacaggagactgttctaatagagagagtgaagagtacaatatgtagtttagttctctcatttggtaggtgcagacacagaaggaatgaaaggctgcatttacacgattagctagatctgtacaaacatttagtactttaacttttctcaaagccttttatgtattatcctatgggtaatgttatcccaaatgtatggataaaattaaaacaagaacactaaatgacttcacaaagacctgaaaggcagatcaacggcataactaatattaaaactcaggactagtgctctgaacatcaaacctcctggatgaggtcttccgtggcacatctctcatttgttgaacagtttttaaaatactgtgtgctgggctttaggttgagagataggacacgtgatttatcccttcagggtgtttgcatcataaagaggcctgtgatcttcaattaatcatgtggccaaagttatttctaggggtcagggagtcattgacaattcattatgccaaatgtgccaaaatgccgaaaaaaaaaaaaccaaaaaccaataatgtaagtctcctgaatataaaattttcaaaaactgaattagaaacatttttttttactctagcaagagcaattcaataaaagcagacatataaaggataattttttaaatctgtgaccaaaattgaatatgagattgattcatctacaaagtgtcttacttttctgtagtacaataaaataaattatactgtcctagacaggcaaacttcaatataagggagatttaatgtcgtctgtcctatcatagtgaaatttgactccactattagtttctgaatactttcatgatttccctcctgctagtttaccatgagacaccatctcagacttctacacagctcatttgcacccatcacaatatataaataaacaggagtgtgccttttctctgccgtatttccactcaactaattcctgtatctttcagctccaccagttctttgtatacttgcaaataatggctgaaaatatttatattttttcttgacttcatatttcttctacacactattagttttcttactctgtaatttaagtgacagatttggagtgggacaaatctgtatgaaaacttataaattaaatttcccatttaatgagaagattttaagtagaggttaattggtaaattactttctcccttttcccccatgctcttttcatattctgattgcattatatgtatgtatatttctagttatgtgtacaactatacaaaatttgggaatataaattcatttcattaacacctgtaccctttttgctcctactcaactcttttttgcacgcaattcagcaaaacttttggaaatagttgtccatattcactggcttctctttctcattttttcacctctcacacaatcctttggaataaggttttcatcttcataattccacagaaacggggaacactcatgttgccaaattcaatagctacctctctaacctcttcttattccatctcttagcacacaacacagttgaccagttgctcatgccctgtttctttaaaaactcctttttcttggcttttttgaaccacacttgtctgtgacagccaccactccttgacagctgtgctgtctccatttgacctctaaatgttaggactgatttgtgttaatagaattataggttacggagatggagccctcacaaattggattagtgtccttataagggccaaggaaaccagagctcttcccctcaactatgtgaggacagagtgagaaggttccttctgagtcatatagtgggtgttcaccagataccagttttgctggtgacttgatcttggacttctcagtacccagaactgtgggaaaaaaaatttggctgtttataaactactccacttatgctattttgttataattgctcagagtaagaaatgaagatatttcatcttacttatcttattattgctatttctccagctttggacacaatacttagcactttgtggaaactcagtatattttttaaatgaataaatacataaatgaattcaccaaataggtagttaaagaaccataaaaatcatcatatccttgttttcgaagtgaattagaaccagctgagttgcacagaattgtaaatcagaacatcttgctgatctttatctctgcatacagacctgattttcatagaactcactgtctgaattacatgtgacaacagatacaaggatgtagatttcactttattttgcaaacatgaatttcatcatctacatagtggatagttgattctccagtgaagtcagatttctgaagtgttaatttaatattgtgctattatactttaaaaaaaaaaacatagcacacatcttctagtaaaatggcacatatctttttgcaatagtcaggaactacagacatgagctaaatcatgtatttgaaaggtagtcccagagtggctaagtcagaataaggtatatctttctttctaaagtactgctttgattatattattttctgctcctcaatccacagtagcacctattagcagttctgcctttggcaattgacatatgttatctcctgttgctatttatcaatttactgtcagttatgttctctctctccaattggactgtaggtttttggcaagatgcaatctggaagtaagctctatcaaaagtagttattgaatagatatttgtaaaagattacgatgaaaacatttctaactctccaaatctaactccaccttatctttagtcttaaacacaacgtgaaaattaaactaaaaacattgaacaaattaatcttgacactgtaatatattgcaatggctaaaataattttgaatcctaaatattaattttgttatacatcttttttatatatatttccctgtatggaacatgttatgaataaatacttgatgttctttacacagtctagagcttgctacatattgttgatcatctcagaaacagcttaataaaatcagcatttgaaaatcccagtatcagcacctgtgacattaataattctggtgaaacaggtgcttcctgggaatttcaaacatttgaaaataaagtgataggccggacgcggtggctcacgcctgtaatcccagcactttgggaggctgaggcagatggatcacgacgtcaggagatcgagaccatcctggctaacacggtgaaaccccatctctactaaacaaaaccaaaaaaattagccgggcgtggtggtggacgcctatagtcccagctacttgggaggctgaggcaggagaacggcgtgaacctgggaggcggagcttgcaatgagcctagatcgcgccactgcactccagcctgggcgacagagcaagactccatctcaaaaaaagaaaataaagtgatacttcgagggaattagttgtgtcacagataaaaatagattgtgcttcactgcactcattttaaaacatagtgactgtcttcaatgctactttacaagtgaggaccagataattaactgaagtttctttctcaagcctgattgcgttgtttctttttcttcactactcttctcctttactgtcccttcaccatttaggaggaggatatgcttttctacacatctgttccttaggaggatggttgatacagctaccaaaaaaatttgtttcatgttttaaagtaatcatcattctcagtaaactatcccaaggacaaaaaaccaaacaccgcatgttctcactcatagatgggaattgaacagtgagaacacatggacacaggaaggggaacatcacactctggggactgttgtggggtggtgggaggggggagggatagcattaggagatatacctaatgctaaatggcgagttaatgggtgcagcacaccagcatggcagatgtatacatatgtaactaacctgcacattgtgcacatgtaccctaaaacttaaagtataataataataaaaaatatgctttgcagagttaaagcaaagaaaaagtcgtaaaagacaaactatattttgtctgtgagagccagcttgttaagacagaaaagttgtttcttttttacatttctaaaacttggttttaaatgtgaagagacaaatactaaaagcaacagaacttaaggtttctctgtaaacaaatgtgtttgtttcagtcataccagatattatgacaaacaaatgctaagtttatgagatttaaaaccatgaaagtatatttttgaatgcattaaaataccgtgaaggtgttaatggttcgtaactgggagtggcacaaaggccagttctgcctcctgaaatcattgacagacactgagctgatggaagatttgtttttttaaatatatctcttttaagatcatcgtgggtgttaacaggtagccaagaatgtaagaaggagaatattaaggttgtacatttgcttaactgccttggtctaggaaaaaaaaaatatcttccatgtactttttagcctgaagaagttacttgaccccagtcagataaaaagaaagctgacaaataaccatatcccaggaataactctgttttctacaagaggactaaaacaggaagccaagggaatgagtctgtggttatcattttctaaaaagtgggctctgtcccctgtcaatttctgaagttgaaattttagaggtagagagaaacagaaaccaacacataggtatgggactcagagaccagagagtgtttgtgctcaacttgctttatggaactcagaagagatataatctcatggagaattcactgctcacacaggctagcatcagcagaattgtaatggtggcaaaacagtatagtccgatatatagattgaaataggacccatcctcagtctatcagaggtccttaacgatgcaggagatcatctgaaaatagcttgtcctgtcccatattgattcaagataggccagagagaccttttagttgcaaaggatagacagagtaaatagcaagtacctaatgactggagaacagggtagcagcatagacatggatatcaagcttaagtagggataagtgttgacaacctacggtatgctggcattggtggggtgaggttttcttctccttagaaaagaattcagttaaatagaggtatagaagaataaatagaagtatttaatgatatggcttagcttggtggtttgaaatacatgcctgctacatctggattctgaatatttctgtatttgtaaccatctcaaaaactccagggtattaataaatttgtccataaatacttaacaattggaaaggcatatggctttagatttaccttttcatttcaggattttactcattaaatcagtattagatgctgcagcataattaagttgaagctgacatttgagaacattatttgtttttctctttcatgacatctaaatacatttgatattttttcccaattgccaatcaagtattcttccactagaatttacttttacctgattttaaaagaacattccaatcatggttggtagccatatggacctctcactcaactacaatgtcagtggctctgggagctatttgtctgtgtctgagtgataaaatctttctcagttccctttgagataattttcctctcattttctactgccaaatggacaatctttggatttctccctgaagtggtctttattctcaagtgaccttcaaatggtttacctctgagatattcccacagcacacccaaagtgaagatatagccccttcaaagttggcaacaatacatctagaagttttctcatggtggtaaaatagacaataatttcattttttctaaatagactcactcaagtcaatatccacacagcttcccacacacaataacccattccttttgtatacccttggtgccttagtctaggtcttttttctgaccatagcatccttcattatcttttcagatctcacttctttcaacatcaagccttcttatgtccagtgataagatttatgtctttttgtaagaattttatgtatttattaaaaacatcatttaattgacttaatcagtttcattgggattacttttaaatctttattaaagatccttcagagcaagggccattttatacatcttttttggtaatttttctatattgttacctaagttcacattatcatagagattaatcagaccacacaaaacagtgaaattgatagtgactatagagttagcctgagtgttcagtacaggatgactggctccttttgaataataaagatgatctctaaaataatagcatatatctcattaatacaattatgatatcttgaactgtgcaggacaaacagtcctatttttattatatgaaatagtctttgtaagtatctaattacctacttcccttgataacactgaaaaaagaccttgaatcttaaaaatttccactttaaagtaagtatagtgcaaggacagatcaatgtagtactatgtttttatgccctctctgcagcgagtttatatataacctgaacttttcatagctcccaaatccaaaaaaaaatgcttgcaaccataatttactttttacatttaaactatcgacaataacttcatagcactggtccagttgctcatttcacttgtgaaaggggtcaaattttcacctagagttttattgaatgccacattttatagtaactgttactcaggcttattgtttctcacagttgtttgtttatttttgtgtgtgtgttgttttctcctatgtttatcatcacggttgcttcctgaggaacttttgctagtcgtcgcttcaaagtaatatctccttttcaagaatgggtaacttgataacaatgaaacaatcaaggtattgactcagaaagacttaaccaatgtaaacacacttctctttactgatattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtctcttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgttgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctataaacatatgtgtgcaagggtccttttcatataatgacttgttttcattgggatatatacccagtattgggattgctggattgaatggtagatgtacttttagctctttaaggaattttgatactgtcctacatacaggttgtactaagttccattcccatcagcagtgcaagctgctttttccctacatccaccccaacatatattgtttttcgacttttcaataacggctattcttgcaggagtaaggtgctcattgtggttttaatttgcatttccctgaagattagtgatgttaagcatttattcatatgtttgattgctgtttgtgtatcttcttttgcaaaatttctattcatgttctttgcttactttttaatggaattatttggggttttttccttggtgatttgttggatttccttatcgattatggatactagtcctctgttggatacatagcttgcaaatattttctcccattctgttgatcatctgtttactatgttatttcttttgccgtgcagaagctttttggtttaattaagtctcatttatttattttggtttttgttgcatttgcttttgtggtcttagttataaattctttgcctaggccagtgtctagaagagtttttgtaacactgttttctagaatctttgtggtttcaggtcttaagtttttgatccattttgagcttacttttgtatatggtgagagttaggaattcagtttcattcttctacacgtggcttgtcagttttcccagcaccatttattaaataaggtattccttcaccaacttgtgtttttgtatgctttgacatatcacttggctgtacatatttggctttatttctgggttctctgttctgtgccacgagcctatgtacctacatttataccattgccatgttgttttggtaactgtacccgtgtggtacaatttggagtccagtaatgcgatgtctctaagtttgttcatttgcttaggattgctttggctatccagcctctttttaggttctaaattaattttaggcttgctttatttttctaattctttgaaaaatgctgttaggtgtttgatgggaattgcactgaatctgtagattgctttggcctgcatggtcattatcacgatattgattcttccaatgaataaacatgggatgcatttccatttctttgtgtcagctatgatttctttccagagtgttttgtagttctccttgtagtgatctttcacttccttggttaaggtatattcctggatttcttttttatttatttattttttattattgacagctgttttaaaagggattgaattcttgcttttattctcagcttggtcatttttggtgtgctactgatttgtgtacattgattttgtaatctgagactactcaattcatttatcaaacctaagtgtctttggaggagtcttaggattttctaggtattcaatcatattatcggcaaacaacgataacttgacttcctcttttccaatttggatggcctttatttctttctcttgactcattgctctggctagtatttatagaactatgtagaataagagtggtgaacgtggtcatccttgtcttgttcctgttctcagggggaatgctttcaacttttcctcattcagtatgatattggctgtgggtttttcatctatagcttttattattttgaagtagttttcttctatgcctagtttattcagagtttttatcataaaggggtgctggattttgttgaatgatttttctgaatctattgagatggtcatgtagttttgtttttaattgtgtttatgtgatgtttttaattctgttttctgtgacgtattctctctcgatgaatctagctaatagtctatcagttttattttttcaaacaatgagttttgcgtttcattgattttcatatatttttgtgtttgaattttattgagttctgctctgatctttgttatttcttttcttcttctagctttaggtttattttgttcttgtttcttctgttccttgaggtacgacattagatcgtcaactgtgcttttttagactttttgatgtaggcatttagtgctataaagttccatcttagcactgcttttgctgtactcgaggttttgataagttattgcactattattcaattcaaagaatttttaaagttttgtcttgactttattgttaaccagataccattcagaagaagattatttaatttccatgtctttgtatagttttgagggttctgaaactgcctttgcaaaattataactgaggaaattatgacagtgcagtgaaataaatcagaacttactaactctatcttgcttctaacccttaagctgtccttgttcattcctgggtgtaggctggactaactttgggaaggaatttagttcatggtttgactctgaaacaaaactgataacaaccctttcttgcctggtgtccagtctgctttttcaggactaataaattagctacaagattaaaaattataatttaggggtcatacagcctctggctccaagagtctgaaaatccacaaattgctcctagggataacaccactattgtaaaacctaagatcagtgcttgagatattttgcagaccctgaactccatagatcagccaacaccacccagaccagtaatctggcccaaccagttctgccaatgcacccaagtacagaagacattaagaaaacctaactttgacctcctatggttccatctccaacttgaccaatcagcacttcccatttcccaagcccctacccaccaatttatctttaaaaagtctgattcctgaattctcggggagactgatttgagtaataataaaactccagtctcccgcatggccagctctgcatgaattattttttcaccactgcaattctcttttcttgataaatcagctctgtctaggcagcaggcaatgtgaaccaattgggctgttacagttctttgtgaagttgatttctagttttattctgctgtggtctgagaagatatttgatataatttccattttaaaaaatttattgaggcccgttttgtgacctattatatgatcagccttggagaatgttccatgtgaagatgagatgaatgtgtattctacagatcttaaggtaaaatgttctataaatacctggtaagcccattagttctagtgtatcctttacatttattgtttctctgttgactttctgtctcaaagatttgtctagtgctgtcagtggtatatagaagtctctcaccattactgtattgctatctcattacttagatgtagtagtaattgttttatgaatctaggagctccagtgtttggtgcatacatatttaggattataatatctacttattgaatttatccttttatcacatatgtagtaatgatctttgtctttttttaaatttttgctgctttgaaatctgtttggtcttaatatgagtatagctgctcctgctcacttttggtttccatttgcatggaataccttttcctacccttttactttgagtttatataaatccttccctgttaggtgagtctcttgaaggcagcagatatttggattgtgattttttaaatccattctgccattctgtatcttttaaatggagcatttaggtaacttacattcaacgttaatattgaaatgtgaagtactgttctcctcatcgtgttaattgttacacagatagtttcttttcattgcattattgttttataggccctgtgagttttaagcttttaagacattctattttgctgcatattgggtttttgttttaaggtttagaacttcttttagtatttcctttagtgctggtttggtagtgacaaattccctcagcatttgtctgaaaatgactttatttctcatttatgaaactaagttttatgggaaacaaaattcttggctgacagttgttctgtttaagaaggttgaaattaggaccccaatcccttctggcttgtaaggtttccgtggagaagtctgttcttagtctgataggttttcctttatggtttacttgatgcttttccttactgttcttagaattctttctgttgactttagatagcctgatgactatatgtcttgctgaagatctttttgcaataaatttcccaggagtcttttgagcttcttggatttggatatctagatctctagccagaccaggaagttttcctcaactattccctcaaatatgttttccagatttattattttcacttctccctcaggagaaggaaagccaattattgttattcattttatgtatttccatatttcttagagactttgttcatttttattcttttttatttttgtctgattcagttaattcaaaagccttgcctttgagctccgaaaattctttctcctagttgttctagcctattgttaaacatttccacggcattttataattattgcccaagtgtatcttttattttcagagtttctgattaatttttctttacgatatcactctagaaaatttttcattcatatcctcaactgccttctaaatttctttatgattttttttttgcctttctctgatatctccttgagtagcttaataatcaaccttctgaatttatctggtatttcaaaaatttcatcttggttgggtccactgctggagaactagtgtgatcttttgcgggtgttatagcaccatgttttgtcatattaccagagttatttttctggtccttctcatttgggtagactattttttctaattattctttattttacatttgatttaattgtgtttcctttgtttgtttgcttttaatttttttcctctttaaggatgagacttcaatgctttgagttaattgtagcctaatttggttcttggtgctttcagggtcaaagactctgaagagtcccttggttatagaaagtgtttgtatgatggctttctcatatgctggtatagtagcaatgggctcagtgtggaaacaaattcagtatctcctatggggttggaatggtagaggtctcttaaagcttatctcattcccctgtggtggcactttatttatttatttatttccccccatattttatttactggtttgatggttcagatttcaggccagtaggggaggtatccctgggtagggaccagttgtaggtaaagcaggtggataaataaagtcccagcattgacagaggtaagtggaggagcttaagtgagttgcactgaggttttatcaagtgaagttttggaaccactttagctccctgccaggtcagtaggaaagttatccacctctcagacatgctactatcccagtgttctggttattcagatcaggcaggcacccttttcatctgtagaaatgttgaccttccaagtagagaggaattgtgactctgtctctcatgcaagcctgaacccaggtagtgctccttctgtggggatgcagtaccctgatgtgttccagaaatgctgtctatggttgcacccatactgagctcctgttggagaaacccaaactgcgcctatgatggtggataaggggggaaaggcttcctcttctccagtactcttcatggataccaggactgtctgactgttggaactgtctgactgagagctgaagaccttccctgcctagccccgcacctcaacagtactgctgctgaaggaagctttccaccagtggaaggatcctgtggtcaaggcctgccatctggattcttttgtcttacagtgtgttctcttggggttggaatggtagaggtctcttaaagcttatctcaatcccctgcggtggcactttatttatttatttatttccccccatgttttatttactggtttgatggttcagatttcaggccagtaggggaggtatccctgggtagggaccagttgtgggtaaagcactctcccttcccctaggagtgggaatccctgggagccagactactgtgggtgttgttgctcctctgggtctagctgctcagtggaattgccccactccaggctggtgttggggaaatgtttgcaagggatccactgatgtgacctgtcctcaagttttctagcagtgggtaatggcaccagctctaatgggagtggcaaaggagtgacatagattctgtgaagttccttggttattgatagtcttagtgtgttggctttcttgaacactggttatagcagtgatgaactggtcacatggacagattcaggagcccctggttagccagagcggtgtaggcaatggtgatagctgagatgcacagccttctccttcttggacacggtgttattctaccaagaaatacagtaatggactgtgtcggttgtcctgcagccaggaggtggtgcttgccaaaaagcatcagctgtggtggcaaccgtggcagttttgcttgccttatgtttcctgttggaggggagtatctctgatttctcaggcaatgggcagggccaagtagctcccaagagattttgatctttttgttgagctaccagggccgatggcagggcaaagccaggtgggagctgggttgggcaggtttgcattctgagtctctgtgtgtagggcaaacagcagcccctgtgggtttttggggacaggggcaggtttcaaaccgctgggttgatgttccagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttggtaaggcggtaatcagcactcaccactaacagtagtcataagattttcccacagagaaagcaaccatggcttttaggccttgcccttctctgtctgctgcaaagccaggcacctggcatctgcacccagggctcctgcacccatgggcctacactcatgactcttgcactcatggcacgcttttcactctccccatcctggccctggccaagggagttcgtgtccacccaaagttatattattaaatccctttgggagcctctttctacctgtggccaccacttgaaatgtttggctctcttcctcagcaccctttgtgaggaacagtaaagaatagctaccctcagttcacactgggatctaggagtccatgcaagggtcttcccactgctgatcctacttttatactccatgaccctccccaactctgtttctgcacagggtggggttagggccttcccccgtgtattgagctttcagggtccccagtgggagtgtatatcctagaggcaaactctccccttctcatactctatgtactcacagcctttgcctgactcacactgtaggctgcagcctctagcatccttcaaagtgtccataaattcctccggttttcctgttcagttcctgtgtcacttcttgaaaaaaattcacagtgtgaatctctgcacactattttgtccttccaagtgtgagagatatgctagcaatgccttcaatccaccatcttggggggaaaaaactctaatttgcttttaaattagattttgtattaagacttttaataatcaaaataatcactgaatgctgaactgaatttttaaaatattaaaaatagcaatagttcagtctgttaatcactaacctaacatacacatttattaaaaccctatttccaaagttgaactgtaattaagtttgtatggagagattcacataaaagttaccccattacttctttagtagtttttttgttgttgttgtttgtttttgtttttgagatggagtcttgctctgttgcccaggctggagtgcagtggcaccaacttggctcattgcaacttctgccttgctggttaagtgattctcatgcctctgcctcccaagtggctgggattacaggtgcccaccactacacctggctaatttttgtatttttagtagagatggggtttcaccatgttggccaggctggtctcaaactcctggcctcaagtgatccacccgcctcggcctcccagagtgctgggattacaggcgtgagcgaccactcctagaccctttagtagttttatagtttgggctcttatgtttaagtctttaattaattaagatttttttaatatggtgagagatagggaatctagtgtcattcttctggatatgaacatctgttttcttcctggaccatttatcaaagatggtatctttcctcaatgtatgtttttggagcatttgttgaaaatgttccaatagtcacaaataaacattctattaaaaaattttttgaataatggttagcatctacattacagttaatagctaggtcttactgttaataattgactaatgaactgttatactaatattcactttcaaaaccatcataaaaaaacagttttatgaaatagatacttttagaattaatggttaatgaaaacattcatttttttctataaagttatttttgtgtaatattttttcttttttattgatacgtaataatagtacatatttaagaggtgcatgtgtgattttactacaagcatacaatgtataatgatgatcaattaaggtaattaggatattcatcacctcaaacatttatctttttgagtgttgagagcatttcaaatctttacttccagctattttgatatatacaataaactattgcttatgtccccatccctaccctcatttatgcactttttccagcctctggtacctatcgttttaccctccctacatgagataaactttttaacacccacatatgagtgacaacatgcaatatttgtctttttgtgcctggcttattttacttaacatagtccatcagttccatccatgatggtacaaatgacagagtattatatttttatggctgaaaagccttttatttataaagtttttatctgttaatctgttcacaaacacttgtattggttctatatcctggttattgtgaacagtgctgcaataaacatgggaatgcaggtatctacttaatatactgatttcctttcctctagataaatacccagcagtggcattgtggggtcatatggtagttctatttttagatttttaaaaatgaacctccagactgtttttctataatagctgtactaatatatatttccaccaacagtatataattctcttttctccatattcttgctatcatttgtgtgtgtgtgtgtgtgtgtgtgtgtgtgtgtgtgtattttgataatagccatgctaattgggtcgagataatatcttactgtgattttgatttacatttccctgatgattagtgatgttggcatgttttccatattcctattgaaaacttgtatgtctacacttgagaaatatatattaatattatttgcccagtttttagggagattatttgattattctgttgttgcattgagttcctcatatattctgcatattagtcccgatggatgaatagttcacaaatattttttccagttctacaggttgtacctttactatgttgaacatttcttttactgtgtagaagctttatagtttaatatagtcccatttgtctatttttttgttttgttgtatgttttgaagtcttagtcataaaatatttgcattgactaatgttttgaagaatttctcctatgttcttgtttagtagttttatggtttggggttatatttaagtctttcatcaattaagtttttttaatatgatgcaagatagggaatctagtgtcattcttctgcatacggatacctgttttctccaggaatatttatcaaaaatggtgtctttcctcaatatatgtttttgaaacatttgttgaaaattggttggctgtaaatacaataatctatttccaggttttttattctgccctgttggttaacgtgtctgcttttgtgccaatatattgctgttttggttaccatagcttagaagtatatcttgaactcaggtagtgtgatacctccagctttgtcttttttgcttaggattgctttggctatttgaggtttttacggttacaatttttcttttaatttctgtaaagactatcatttgtattattttttttgagacagactctacctctgttgcccaggctggagtacagtggcacaatcttggctcactgcaacctccacccttcaggttcaagcaattctgctgcctcagcctctcaagtagctgggattacaggttcacatcaccatatctcgctaaattttttgtatttctagtagagacagggtttcaccatgttggccaggctggtcttgaactcctgacctcaggttaactgcccacctcagcctccaaaagtgctgggattacaggcatgagccaccatgcccagattgtattttgataggaattgcattcaatctgcagattgctttcaatagtatggtcattttaacaatatcaattttttcaatcgttgagcatggaatatttttccatttgttttcatcctcttcaatttattttatcagtgctttgtagttttcctaatagagcaattttcatctacttgtttaaatttattcctagttatttttatagctcttgtaaatgatattgttttcttatattcttttttttatctagtttgttattggtgtatagaaatgctactgttttatatgttgattttgtattctgcaagtttactgaatttgcttatcacggctaagaggtttttggtggaatctttaggattttctatataaagactgtgttatctgcaaaaagagacaatttgtcttcctcttagattggagtgtgttttctcttctttttcttgactaattgctctggatatgatatcaagttctatgttgaataagagaggtgacagtgggtatccttgtcttgttccagcaggtttccaccttttctcaatttcaccttttctcaattcagtataatgttagatgtggtttgtcatatgtggtctctattatgttgaaatatgttccttctatgcctaattagttgacagtttttatcatgaaaggatgttcaattttatcaaatgttttcctgaatctattgagatgatcatataatttgtgttcttctttttttttcttttttttgagagggagtctcactctgtcacccagactggagtgcagtggcacaatctcggctcactgcaacctccacctcccaggttcaagagattctcctgcctcagcctcctgaatagctgggacaccaggtgtgcacccccatgcttggctgatttttgtatttttagtagagatggggttttaacatgttggccaggctggtcttgaactcctgacctcatgatccactgcctcggcctcctgaagtgctggaatttcaggcatgagccaccacaccgggctgatttgtgttcttctttctgttaatgtgatttatcaattctattgattagtatatgttagatcatttttacatccctgagataaatcctacataatcacagtgtaccacctttttcatgtattattggattcagtttgagtactttattgataatttttgcatctatatacatcagagatattagcctgtaattttcttttttgttgaattcttgtctggttttgtaatcaggtttagctggccctatacaatgacataggaagaattccctcctcttcagtttttttaaatagtctgagaagaatagatgttagttcttctgtataggtttggtagaattcagcagtaaagccattcagttctgagcatttctgagttgggaggtttttttcagctattattgcttttgattctatctctcttatagctcaaataatatctgtttttcctatcagggtgctgtggtgttggtgaatataccttcacaaatgttatatactcttgaaaattgattcctttattattatataatgatgtcctttgtctttttttatgtttttgacttaaagtttattttgtgtgatgtaagtgaagctactcctgcacagtttttgtttccctttgtgtggaatattcttttctgttccctcactttcaatctatgtgtgtcttcacaggtaaagcaagtttcttgtcaacagcatatagttgggttttgtattttttatccattcagccagtacatactttttaagtaaggaatttaaaccttttacgttctggaatgttattgataggtgacaacttactcctgtcattttgtcaattattttctaatgttattgtatattgtttctttcattctcttattttttacatttacaatttgattatttttgtagcaacaacatttgatagctttctctttctcattcgtgtatatactctaccagtgaacttagtacttttgtgtcttttcatgagggtagatatcttttcactcccagattttgcattttcttaagcatttcttaagcatcgtaggatcaacctattggtgacaaattcccttggtttttcttgcctgagaaaggctttatctctccatcattttggaagaatagctttgcacagtttattattctttactgccatgttttgttctgttttgttttgttttgttttgtattgttagtactttgaatatcccattctttcctggcttataaggtttctgctgaaaaattttgagaaattagctgttgatctgatggggatttccttatatttgatgatgttttttcttgctattttgatggttttactctaccttaaacatgaccttttagaattgaatctacttgggaatatttgttgcatttcctgtatctgggtgaattcatgtatatggatgcttcttataaatggatgcttcttataaatggatgtatatattttgttcaagacttgagaaattttaacctatcattttgttacataagttttccatctctttttctccacaattcccaaaatttgaatatttggttactttatggtgtcccatatgtcacataagctttcttcattctttttaagtccttttttcttcttttgtctatgacatttcaaaagacctgtcttcaagtcagaaattctttattctgcttgatgaagtctattgctgaagattttgattgtatttttatatcactgattgaattcttcacttcaggatttctgtttgtcttttttatcatatctagcaatttatcattcagattataaattattttctaatttcccaattgtttatctgtgttatcttgtatctggctgagttcttcaatattattattttgaattcctttttagatattttatagatttttcttttttgtgatttcctactagagaattattattttccttcggtggcattatgtttccttgctttttcatgtttcttgcatctttaaattgacatatcagcacatcctgggtgacagtcacttacttcagttacatggattggcttttacgtggaaacactttttttcaattgctgagcagttctgctttttaaagcagcaactgagctgtaaagcagacccatccttagacaggaaactgaatctacgtgggaggaagacacagtggtgggcaatctggaagctagaaggaaggacagtcagagtgagtattgtaaagccagaagcatggcttatctaacaccccgctgggatatctaagagagcccccttctcaggtttttttctgtctcaaaagaaactgaggcatgggtagtgataaaatcacaagtaatctcaccctaccaaaacccagtctcctcattaaatgctacagaagtctggaaggagttctcattatacaggcctatgacactctcactgtccaacagtcttcatttctggttttgttcaagattatatccctctcacacacaaagaaagcatttatcatgagagaattttggtactttatgaagttgtctgcctttaattatttatattgtcttctttctcttagtatttttgttttttttttctttagggaagggatagaggggactgtttttgatattgctattcttcttctgtcatctaggtaaagcttcctttgaaaatgccaacctgtttgaacactcctcaggagacatgatgaaagatgttctctataatttatctgtatattcccagtttccaaatatggcaataacagcaagaataaacagacggatatctcaataagatgaaaaattagcaggaactgatgaagggacactcttatcgctgttgctttccattatgattgttgaactcaaacagctcttcctgtgtctcaggcagaatcaattatagatagaaaattaacttacaaatatctttatttacttgattaggaaaaggatactgagtagtcagcaagtaatagttaaaaagaaatcataaaattggaatcacaagatctgtgttccagggcttcctttgactttaaaaagtggattacccttaactgagtcacatacttctttaagatttttttatatcatcatctgtacaacaggaacagcaaactagaagatctctgagatccccttaaattttaaattgtttcaaattataccctaagatatctgagcaagaaagatttaaagagcaaaattttacctcaacagagatgagagtttgttagtgtaattgagggggtcaaaacaaaataatatattgttaaatagtgggtgaagacttagagtgatagaagtcttttccataaaaaaatttagtttttaataaatcctttcactgacatcaacacagtaataaaggagaagcacctataacacggcttcaatagcaatttttacagcaatgtgtaaaacatgccatcagagaagaattcctgttccttaaatttccacgttacccagcatctgccatagctaacaggaaatgaaatagaataaactatggaaagatattgaataaagactccttaactatggagtttgataatttgaagtaaggaaataagaattctctgcttttagaataagaaacataattccaacaaatgaaaaatctactgtttctccctgtggaatgtgaacaatctagcataggtttctgaagggaacctggcgctatggtagaaaatgatcagaactgtattgatttacatatgtttcttactcttataggcatataggagccttgcatgaccacactttaaacaaatattttcacagtatttattattgatagcatacatgcattaaattgttttttataaactctaataattaacttcataaaccgtcttaaataaatgtttttcttatttgtataatgaccttagtttaaaatgtaacctttcagatattttcagaattacgtacataaagagggtgaacctatcttagaaatacaatagtttccgctttccagaacaataagactaatgaaaaaccgctttaaataatgttgcttgagggatggtttctctctaaacaccagaatgtgtagaaaatgtttacacggcaaaataaataacctgttaagaggcttaaaattttagttagaacaataatatacacagtcaacataaaagccttgtttacatggttgtttgggaatattttaaaacaaaaacagtttgcttcatattcagatctcccatggctcccaaagaagactttagttagagaaaaagagttgtttaaataaagagaattcatttatttctgttatagtgtaataataataactagtcatttatagttattcatacatttgtataatttgaacaaaagccatcagcctgaggctttctttctcatttctgcaaataaagatatagagtgtttgaggaattcatgtagtttgcaaatatttgcttttggagacaaatgatgataattaaataaaatgctgtgtgttttgttgaatgagcaatgtaataacatttaggcatgtaaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgcattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaaagggatgaaaaagcatatttcatgccaatgtaaaccaaaaaggagcaagagttgtgatacttatatcaggcaaaatagatttcaagactaaaactgcaagagacaaagagggtcactatataatgataaagggatgaattcagcaaaaggagataccagttttaaatatatatgtaccccaacatttggagaattgagatatataaagcaaatattatagctaaagagagagatagacctcaatacaataatagctggagacttcaacaccccactttcagcattggacagatctactgaacagaaaatcaacaaggaaatatcaggcataatttgtactagagaccaaatggatctaatagatatttaaagaacatttcatccaatggttgcagaatacacatttttctcctcagcatattgattattctcaaggataggccatgtgttaggtcacaaaacaactcttaaatatttcaaaacaaattgaaataatatcaagcacattttctgaccacaaaggaataaaactagataataacaagaggaatttgaaaactacatgaatacatgaaaagtaaaaattgtgcccctgaataaccagtggatcaatgaagaaattaagagaaaaattagaagatttcttgagacaaatgataatgaaaacacaacatacgaaaacctatgggacacagcaaaagcagtactaagatgaaagctgatagctctaaatgcctacatcaaaaaagagaaaaaacttcaaatatacaatctaatgacgcatcttaaagaactagaaaagcaagagcaaatcaaacccaaaactggctgaagaaaataaataataaaaaatagagaagaaataagtgaaactgaaataaaaaatagaacaaaagtcaacaaaacaaaaagtagtctttttaaaaagttaaagtaagtggacaaatatttagccagactaatagaaaaagagagaagatgcaagtaagattagaagtgaaaatggagacattacaactggtatttcagaaatttaaaggatcattagcagctactatgagcaactacataccaacaaattggaaaatctagatacaataaatgaattcctagacacatacaatctaccaagattgaataatgaagaaatccaaaatctgaacagactagtaataaataacaagatcaaagccataacaaaaagtctcccagtaaacaaaagcccaagacctgatggcttcactgctgaattctgccaaacatgtaaagaagaaataatatcaatcctactcaaactattctagaaaataaaggaggagagaatacttccaaactcattcttcgaggccaatattcccctaatgccaaaactggacaacaacacattaataaaaaataaaacctataggtcagtatctcttataaatattgatgcaaagatcttcaacaaaatactagaaacccaaattcaacaatacattagaaagatcatccttcatgaccaagtagtatttatctctgggatgcaagtatgattcaacatatgcaagtcaatcaatgtaatacatcaatagaatgaaggataaaaagcatctgatcatttcaattagtactgaaaaaacattttataaaattcaatatccctttatgttaagaccctcaaaaaactgggaatagaaagaacatacctcaacataataaaagcaacatatgacagacacacatctagtgtcatacggaatggggaaaaactgaaatcctttcctataggatctagaacatgacaaggatgcccactgtcaccagtgttatttaacaaagtactggaagtctttgctagagtgatcaaacaagagaaagatataaaaggcatccgaattgaattgaaagaagtcaaatttttcttatttgcttaggatacagtcttacatttggaaaaacctaaggactccagaagaacactactagaactgatcaacaaattcagtagagttacaggaaacaaaaccaacatacaaaaatcagtagcatttccatatactaacagtgaaaaataaaaaaaattaaaaatagtcccattatactgaccaaaaataaaattaaatgcctacgaattaatttaaccaaagaagtaaaagatctttacaattaaaactataagacactaataaatgtaactgaagaggaaaccaaaaaatggaaaaatatttcatgttcattgattggaagaatcaatattgttaaaatgtccatactactgaaccaacatataggtttaatgctcaaaataccaatggtattcttcatagaaatagaaaatacaattagaaaatttatatggaaccacaaaagacccactaccctaagcaaatagaacaaaactgagggaatcacattacctgacttcaaaaattttgctacacaactatagtaacaaaaatagcatggtactggcataaaaagagacacatagaccaaaggatgaatgttgagagcccagaaataaatctacacaccaacggtgaactcattttcaataaaggtaccaagaacatacactggagggaagacagtctcttcaataaatggtgctgggaaaactggatatctatatgcagaagaatgaaactagatccttccctctcaacatataaattaactcaaaatggattaaggacttaaatctaaggccccaaactatgacattggaaaaatcttcagaacattggtctgggcaatttgtagtgcactgggagtgtcataataccttgttttttcatatttcctgtattattatgctgattttttgcatctggagaaatagttgcttctatttatttttgaatttattttgttggggtggggctttttccccctgagaatacaacaatgatgtattttgaatagggccgtatggctttgcttctgagtacattcattgttaaagactgcttaagttttttggttataaatagccttaatatagtggcttcctcaaatgctggtagtagtagcaagagagcttgtgcacagcaaccaaaataacagagtaaacaacaacctacagagtggaaaaaagtatttacaaactatgcacatgacagaagactaatatccaaaatttacaaggaactcaaacaactcaacagcaataacaaaataatcccattataaagtgagcaagtgacatgaatagacatttttcaaaagaagacatacaaatggccaacaagcatataaacaaacattcaacatcatttctcttatcattagagatacgcaaatttaaaccacaatgagatataattttaccctagtcagaaagactattattaaaaagtaaaaaaataatagatgtttgtgaggatgtgaaggcaaaagaatgcttagtaaattaatacaacctgtttggagaacagaatggagatttctcaaagaactaaaaatagaagtaccatttgatccggcaatcccactactgggtatctacccaaaggaaaagaaaatattatatcaaaaatacacctgcatttgtatgttcattgcagcactattcacaatagcaaaaatatggaatcaatctctatccattgatagatgaatgaataaataaaatggcgtgtatatagataaaatgctatgtgtagatacacacatgcacacatacatgtatgtgtatatatgtacatatatacacatatgcaaacatatatataacatggaatactattcagccataaaaaaagaatgaaataaatgaaatcatgtattttgcagcaacatagatgaaactggggacattatcttaagcggaacaactcagaaacagaaaatcaaataatgcatgttctcatttacaagcagaagctaaataatgtgtatatacggacatgaagtgtgtaaaaagagacactggagactcagaagggtggtgaaggatgagaaattacttaatgggaaaaaatgtacattatttggttaatggttacactaaaagcccagacgtcactattacacattatatccatgtaaataaactgcagtgtaccacttaaatttctacaaaataaaattaggaatctttgtttataacagaatgaaaaaaataagccactgattgggaaaagctatttgcaatgcacatacagtaagaggcttttaatagactaaataataaaccttcacaaatatataaaaaacagaaaattcaatagataaatgggcaaaagctcacagattcttcaaaattaaataatactaaaatgacaaataaacatatatagattctccacttcattattattcagagaaatgcaaattataaccatagtgacctatcattatagaactgttaagtttaaaaagactaataatggaacagctggtgaaaatgtagaccaagagaaacttatggatacttcaagacatcgtgttgtatatgataaatacatacaatattatgtgtcaaatttaaaaattaaaaattaaaaaataccatctgagggatgtgagatattgaattcttaatacaatttaaattttcttaatgttgattcagattataatgatgaagataattttaacagtgatttggtgaatgataaaaaatagctagctgttttacaaacggactacttaaatgatgctataatgtaaaagcaaattacacaaagtgagatttaattaaggaggatataataatacctcacattttttgattttttaaaatagaattgtgtttagcagttgaattgtcttatttaatattcataaaagcctgggcaccagacactatcatcaaacataatttagaaataagaaaacccaccaggcgcggtggctcacacctgtaatcccagcactttgggaggccaaggcaggtggatcacaagatcaggagatcgagaccatcctggctaacatggtgaaacccgtttctcctaaaaatacaaaaaattagccaggcgtggtggtgcgcgcctgtaatcccagctactcgagaggctgaggcaggagaatcgtttgtacctgggaggaggaggttgcagtgagctgagatcgtgccactgcacttcaggttgggcagcaagagtgaaactccgccaacccatcccaaaaaaagaaataaggaaatcaagtattacagagcacaagcaacttttcctaatgttaggtctaggatttggaagtaagcagtgtcatccagaatttgtgttcttgctatatagaggaagtcaaaacaattacctaaacaaaaactgatattcaagattttcaaattaggcaaagttttagtaacttgtattgataaagaaaaactgcctagaatatcaataaagatttatgaattttcaggattaaaaggaacctaagatgccattctctagctgaacactatttcatcttcctttggacatcattgataattggctcttcattcatgtgaggctccacacattagaaaaatattcctttagtagagctgaaatttgtgttatgttttggtttgttttagcttccaatgactgaccctaactctgtccctgattaatttgcagtctaatttatattatactgggtcgttctgaaacaattagataaacctatcaagtcatacataatttcttctctaaatatttcctgttgtttcatttttttttccacatggaatgattcctgatacctttcctcagggtatgctcatttgtcaacatcccttattgataaaattggaaaatttcttaggataattgcatatataaagagataacttatgtccaatatctgggacatgataaaatctctcaaatttccttaagaattcaaagctgtgatagtctcatttgtgtgtggagtagtcccctcttgaaaattacaaactttatttgtttttaatttatgaatgtttctttatttttcctttgggacaaagaaagaaaaaagtatgcatgagcactatctttttcaatataagattatttatttaggttatatttctatgaatggaattgatggataagaaatcgtctttttggatagagactaagttgctgtaatgaagaaaatcccaaaatacaatcaatggcttaaatatgatagaagttcatttctccatcaggaaacagtataattaacagggtaaccctgcctcatgagaacttctagggagggtggttttctccatcttgttctctatcaactaataagacattgcccttatcttcatgaccaaaattatatcattgcaaaatctgctttccagtctaaagaaagcatcagtccagaacaagagatttcacttttattataaattgtaactgacctggaagctgcacacgtaaattttgttctcattcccttgaagagaatggattcaaacaagacaggttggttgtaaggaggctgaggagtgtggtctccagctgtgaagccatatgcattgcttcagctcttttcctgtgaaaagagaacaaatcaaaatttagtgtgtcaaccatctctcctacagagactacattcttttgtttccatgaatctcgaaataattttcaagattctttacaaatgattattatctttaaaatattagtaaccatattaatctgtagtgtaaaaatcaaatttttaagacaagaaattaataataaaatcaatatcgtgtggtaagaaatataattgactcattaagtaaacatctcaagttacagaaacagaagggtgtgagcatattagaaatgtgtatgttgaccacaagcatttgtgctgtcacaggctttagtgagtataatttacttaaagactagagagcaaaatttatcttgcaggttttttcaatgtggtcagttaaggcagcttctcttgtaccaacttctctgtggtacatcatatgttgctctgaacaccacattctcaaacatctgcttaaagctgtcctctagtaatttagagctcactctaaatagtcacattatattaaaataagtaattcacatttctcatgtatgctggtaatttttctagtaaatattgcttatattgaagaatcatttactaatctttttgctgttacatgaaaaagtgtttgcacaaacaaggtaaataagtggaaaccaaaatttgcatgtttagtgatttcagaggatatcaaaataaataataatgcatattgataaggtaaccaaaatcattcggcattccttcaattccaatcatagacaaagaaagcttatgctattcatttgtgacattctggattctctccacctttcatgtgcctattcatttttaagttttgctccaggatagccctattgaactgtacaatttctgaggaaagaaagcaatacatgcagcatttcaaatatatccttgctgttaaacccgagatggctagttcgcaactactcactggaacctgacctaggagagttctgtacagcatgcagccaatgggaaggaaaagtctccaccctccaggaccttaagctttagttagtgaagataaaatatactctaagaagcaactatttaccaagtctaaatcttaaagtaagccctgaatcattcatattttagtcccacatccagttaatcacgaagtcttatattctaacttctcatcttcacagccactagtttataatatttccaacagtgctgtcattcgtcccaccagctctggtcttatctcactgtaatactcccttgcagagatttctttcactgtgcaccttaactttgaaaggtatagataaaaaaaataaattattacatacgagtaacagaaaacaacttagataatgagtcagtccacatgcacataacccatctctgaattagtcaatataatatgctcaattacccactttctccacattcttatgtggcatacttactctatgctcttcaaaaaagatttatattttcagggttgaaatatgattatgtcatctccattctcagttagaatattttaaatataccctcaaaattcctaggtaagtccaaattcccttatatggttcttgaagttctggaagtggtgttaccttgctctctggatttagctgtagttattactctccatgtgtgctaaagtatgccatttaaaactatttgtagttatctaactttatattctttcttgccttggggctttggcacatgctgtttcttgcctaaatgtacccacccctttcatgttgcttgtaaattcctccttgtcttccatgaccctagtctaagaactaaagtatctttcttaaatgctcccataaaaccatgtactcatcttatcataacactgatagtactctgttgacattgtcaactccctgtttcagatgtctatgaaacctcaactccctgattacagagactatatttttctcctttctatactgagtggctagtacagtatctcatgcatagaaaatatacgataattatttgttaaattgaaattcacaatttgtggcatagattagatgcatttgtgcctaactaaaaaaaggaggaggtttctctttactaggcattatgctggatattaatgatttcaaagttaatgtgctaaaattcctgtcattccagaacacatcttagtttgttaatttctttctcttccttttttttttttataagtggtcacatttgttattattttttagaaaatacttgggataaccccaaatttgaatccatatctgcattgcaaatatggggtagagttaactggggaaaacttgaattttctcttgaaacaaaattcttatgtatctagtataaataaattgggctgacctaccaaaaagaatacatagcatggaagggaatcaataaacaattgtttgaaataaaaatgactgagtagatttgctggaataaagataatccaagggccaggtaaaagatatgaagtctatggattataagtgggatctgagtcataaaaagagatttggagaactgaagatgttgagtgactgagttttgatcaagtatataatgggttatccaagtagataagcatataatagataatttttctacaagatttataatgagcaattttaaaacatctgggctagagaaatataaattgagaaggttgaaattatagtgaaattttgaaaatacattagaacatctccaacaatgatagaacatttcagagtctaataatttcagtccttaaaattttggttaaatgttcaagctgggatgaataatttggcctttatagtctcgtttaaaagcttcaggagctgcggtggctcaggccagttgtcctggagcataaggaggcgaggctacacattcaaggccaacctgggcaacataaaaacctctcatccattaaaagcttcaaaaattgccacaatctagaacactgtaagattgttatattttctgcatgagagaattttaaaatattatttctgaaatattgtctttatatatttgagagtgatctaaagagttaataacctccaaatctgcatcctcactgaagataaaataaaatgaaatgtgcctttactgaagcagaggagattcgggaaaaattcaatcaaaaccttcccaagttagggatttctactcacatttacttagaacttcaaggaggaaagtttttgaaaatgatataggccttccaatatatagttggaacctttttatgattctattatttaaaaaaatttgctattttaaaaaatgtttgtgggaacatactagatgtatatatttatgaggtacatgagatatttttatacaggcatgtaatgtgaaataagcacatcatggagaatggggtacccatcccctcatgcttttatcctttgagttacaaacaatctaattacattctttaagttatttaaaaatatacaattaagttattgtcactgtagttttttgagaagcctccaaactgctgtccatagtggttgtactaagttacattttcaccagcagtgtacaagagttatcttttctccacaaccttgcaagcatttgttacggcctggcttttggatacaaatcattttaactggggtgagatgatatctcattggagttttgatttgcatttctctgatgattaataatgttgaacaccttttgatactcttgtttgccatttctatttcttcttttgagaaatgtctatgcaaatcttttgcataattttttattagattattagattttttcctataggcttatttgagctccttatatattccggttattcatccttgtcagatgggtagttttcaaacatgttctcacgttctgtggggtgtctcttcactttgttgattgtattctttgctattaagaagctttttaaatcgatgtgattccatttgtccatttttgctttggttgcctatgcttgtagggtattgctcaagaaattttttcccagaccaatggcttggagtttccccaaggttttctggtagtagtttcatagttcgaggtcttggatttaagtctttagttcatctttatttgatttttgtgtatggtgagagccaaatatctagtttcattcttttgcatatagatatccagttttcccagcatcatttattgaagtcttttgccccattgtatgtttctgacatccttgtcaaaagtgagtttactgtgggggtgtggatttgattttgtgttctctattcttttccattggtctatgtgtctgtttttatgccagtaccatgctattcttgttactaaagttgtgtagtaaaatttgaaatcaggtaatgtgattcctacagttttgttctatttgcttaaagtagctttggttattctgggtcttttgtggttccatataaattttaggattgttttttctatttctatgaagaatgtcattgttattttgatagggattgcattaaacctatatattgctttgagtagtatgaatattttaacaatattgattctatcaatccatgaacatgaaatatttttccattattttgtttcctgttcaatttctttcattagtgttgtatagttttcattataaaattatttcactactttggttaaattaattcctaggtatttaattttatttctggctattataaatgggactatgtttttatacttcatgctgttgatatgatagatcatgttgattgatttgtgtatgttgaaccatccttgcatcacagggataaataccacttggtcacgatgaatgatctttctaatgtattgctgaatttggcttactagtattttgttgagcatttttgcatcaatatttatcagaggtagttttctttttttgatacagttttgccaggttttggtatcagggtaataacgttcctcggagaatgaatttgggagcactctctcctcttctattttttggaatggtttgagtagaatttatattagttcttcaaatgtttggtagaattcagcagaattcagatgaagccatctggtcctaggcttttctttatggggagggattttattatggcttagatctcattacttgtcatcagtctgttcagggtttggatttcttcctgtttcaatcttggtaggttgtgtatgtctaggaattcatttatttcttctagattttccagcttattggtatataggtgctcatagtagccactaatgatccttttaatttctgcagtatcagtagtgatgtctccattttcatttctgattttattaatttgtatcttctctcttttttcttagtctggctaaagatttgtcaatttaatttaacttttcaaataacctactttttgtttaattgactttggaattttttttcaattctatttatttctgctacaatatttatcatttattttcttctactaattttgggtttgatttgctcttgcttttctaattctttaagatgcattgttagactatatatttgaggtttttttctctttgttgatgtaggcacttaatagctatcggacttccatcttagcatcgcttttgctgtatcccagaggttttggtatgttgtgttccatcataatttgttttaagaaatatttcaattttcttcttagtttcttcactgacccactggtcattcaggagcatattatttaatttttgtatatttgtatagttttcaaaattcatgttgttattaatttctagttttattccattgtggtcagagaagatacttaatatcatttcagttttttgaatgttttaatccttttttttgtgaacatattgtttatacttgagaataatccaggtgctgagaagaatgtgtattctgcagctcttggatgcaatgttctgtaaatatctattagattcatttggtctatagtgaagattacatctgatgtttctttgttgattttctgtctggaagatctgtccaagatgctgaaaatagggtgtgaagtctccagctattattgtattggggcctatctccttctttagctctgataatatttgctttatacatctgaatgctccagtgttgagcacttatatatttaaaactgttatatcctcttgataaattgatttcttatcattacatagttaccttctttgttctcttacagcttttgtcttgaaatttattttgtctgatgtaagtacagcaacttctgcttttttgttttccattggcatggaatatctttttccatctctttattttctatgtatgtatttgtaggtgaaatgtgtttcttatagacagattaatgagacttgttttttcatccattcagttactctatatcttttgattggagattttagtccaactacctcaatgttattactgaaaagtaaggacttactcctgccattttattattctttttctggttgttctgtggtcctctcttctttctctctttcctgtcttcctctagtgaaggtgatttcctttttgtacttggatattgatatatttctgtaggtttcagaagttgcctgttattattcctttgaataaatttgctccctctatttatttatctacctcttctttaaggccaataattcttagattttcccttatgaaactattttctaaatcctgtaggcatgcttcattttgttattcttttttcttttgccttttctgactaggtattttcaaatagcctgtcttcaagctcactagttcttgcttctgcttaattctgctgttaaaggaacttgatgcattcttcattatgccaactgcattttttaactccagaatttctgcttgattctctttaattattttaatctgtttgtctgatagaattttgaatttcatctctgtgttatcatgaattttctttgagtttcctcaacctacctattttgaattctctgtctgaaagatcacatatctctgtttctccaggatttgtccctggaaacttatttagtgttcatttggtgagattaagttttcctggatggtgttgatgctagcagatgttcttcagtgtctgggcattgaaggattaggtatttattgtagtcttcactgtctgggcttatttgtactcatccttcttgggaaggttttccagatatttgaaaggacttgggtgttgtgatctaagctgtatctgctttaggggggaacccacatccagtaactctgtggttcttgcagactcataaaggcaaccccttgatggtcttgaatgagatctgagagaattctctggattaccaggcaaagactcttgccttcttcctttcttccaaatatatggagtccctgcctctgctctagccacctaatgctgaggactggagtgacacaagcccccttgtggccatcattaatgtaatttcactgggccagatctgaagctagcacagcactgagtctggctgaaggcttgctgtagccactccctgattactgcctatgtttcctgaaagcacttgggctctctaatcagctggtggaaaaaccaaccaggcttatgtccttccattcagggtagcaaggtcccccagacccccagtgggtccagaggtatcatcctggagtctgcccttttttaaattaaaaataagcaatcaagaacagcaacaacaaaaaattgccagagtaaacatcatctttatcttaagcaatgtcagagtggaacttaaaacttagaaactggaacttagaatgccttattgaaagaagaacacacatatggacttaaaatggtaccaacagagagaagaccaggaaaaaaaaattaagttcataaactactctttgcattttgcttttatttaagaattattccttgcttctttcaataaattttgattgtgtgagttttcaattctccagaaattgaaaataacataatgtgctcactattcatgattgcataataaaaccacttgggtattaaaaaaataataattccttagctagaggttactgaatgacaatagaaaaaagaagaaagaatctacataagtggagacagttctcactctaagctgctgaatatgctttctgtttaactaagtaaaaagaagtaatcaaaaaacaatttccacaattttttatgaccatattcacctacctgcctctgtatgtacatactgtgttctctctcttgttctgtagatgagccatccacatggcaagcaaagggcagtctctctactatgtcccagatctcattcattcttgcctagacaagagcaatttttctggaactctctcttttctctcttgcattcttttttttctcatgagcatattaaaatgctgctatttcactctcatttgaaagtaaatatagacatacacgtatgtgtatgcatatatgtgtgcatgtgacttcaccataccctccagttactgtcccatttttttctttatttgttttacagtaaacttctcagaagagttggctatattcattgatttcagtttctttacacttgaacctgtttctatcaggcctttgccaacactactccactgacgtagctgtagttaaagtcaccagtggcatactctttgctaaatcatgagattgatagtcatttaacctatttgggctatcggcagcatttgcatagctgatcactcccttctcctagatactttctttgcttggcttctaggacacaaattcctctgctttccttctccttcactggtctcttctcattctttttcatttattcctactcatctttcatatcttttggagctcagccctttgagattcattcgtaagtaagaacaatctatctcactgctttaatgttcatctagatgctcataacttctaatttgtatattcaagtgactgcagaacagagaagtaatctcaaaatatgcacctccaaacccaaatgcccgctattatttactactttgctataaccttttctatttccactccttattcaataagaagcagctcctttccataaggcagctccttatttttgattgtttgggccacaggccttggagtcacatttactctactttttctctcatctgctgtctaatctgttaataaatcctctaggttatgccttcagaatatttccagaacttttatcctctcactgctgcattgttgcctctgttactaaaatatgagttagaccatgcctctgtggtaatcaaagccttcagtggtttacttttaacccagagaaaaagtcggccatgaaaaacatgtacaatctgcctgctcctcctcctcccactccccactcttcacctgtatgatttctcttaattttcctcctatttacactttcacccagagtcttttcattttctcttccatctgtctgaatgttcttctttcagatatttgtctgtcattccccatttcctgcagatttgagtctccttccctgacaggcctccactaaccacataaaatttctaccttccaatttccttttctcttcctcttctacacttttctccttaccatttaccactatctaacaagcaattttaactttattcactttacaaggagttctgactgttttacccactgacatatccctagcactgagcttgtggcacattttaggtacacaataaatatttattgcatattgccatattagaattactgatgaagacccaggaggctgtctttaaaggaagggattttttaaaatgaaaatgttagaaaaggtttcgaagaacaagttgcatttgaattgaggttagattaaatgataggtaatatttgagtgtgtggatgagggaaaggtacctgtggtggtgattactgagtgtgaaaagccaacgatcctcgaaaataagacatctaccaagaacaccgtctttcaatttgggtggaatttggaaggcttgaaaagaagatatgttcaagttactgggaggtaacttgggatgtataagataagcagaaagcctatttgggtcactgaggttaagcaatgaatttcttccctttcttgagcaaacaggcagatccttgatatgttacatttagatatgtgcagtagctttaatatcttcttccagaattcttccagtgacagtctttctgcttatcaagctggctaagggaaatcaaatcaacaaacctcatttcttattgaggtgggccagatacttattcatgcatatttagggaatataaatctcagttccagaatgttcgaactatagactattctgcataagccagaacataattataaacatgtagaaagaaaccactttactccaaaggtgtataatctatacatattttaatagaatttctcttttatacttgggacctaaatttgagtttagaaaaagcaatcagtaaacttacataatgagatttaagaggaaatagtcaagcaggaaattcctctcccgagcaataatttttctacttctcaatctgcacctctttttttcctgcctgactcaaaatagcaaaattctagccttaattctccaggacccctgaaggcattctcttctaatacggtgttttttccttttggttcatcttccatagctgttttgagatcagaggccttggcttccatcaccgcctggaactgacttccctcaccacttttaaaaatcagagataaatagtgaattataaaaatatgagtaaagtcaaaagcaaacactggaaacatgatcaaatacaacaagaacatcaagtgaagtacttcaaatagcacttcaggtctgtatatgtgattagatgagtttatttttagaataatatattcattgaccgggcatgtgttggcctgtcacatgctatagattattagactgacaataacccctatgacttaaggatattattagtgttagctttcaattctacttatataattattaatgattattactgtaattataaataattatttattgagcacctactatatgttaaccacttaatatgaattatcagatgtaatcttcacaacagccctcttagttaggatatattataatttccatttgacaaatgaaggaagtaaggcaaagtgatgttaagttacctgcccaagatcacaaagcaagaggtgtcagacccagaattcgaaggccatctgatcactacagcctgatttcagagtgtagagttttaactattccacaattctgcttactttcagtaatatacaacttcttcagttattaagaagtaaaagtgagagctagctttaatcaggtgcctatacaccagacaccttgcattatttcctttaatctttgcaacagttctacaaattagaattttataggtgagaaagaggttaatttagttgcccaaggtcgttctctccaaaaataaagttctattttccttaaaaacatattggaagattgtcatgaggtcaataatgttcagcaggcatacttctgcaaaatcataaaactcatcttatttacttagtaaaaccatggctaaattaagaaagagataaataaaggtgcattccattatttttcccactttcaaggtccagctcaaatgctgtattttctaggtctagttccttcattaagccttcctcaattccctgatccccaaaaccaactaatcttatatttcaattcaattaaggagaagcaagtctaatggattgggaacagatgtgcatatttttaaactgctgttgcttactgtggaagtcagacctattaaaccctccattttaaaaacctttaccctttacattctgattattttatggtacatattctgcttagtagtagtgttattgtgttgttcttattctgtcttccaaatgataagcagatgataagcaaagacttttatattcattcattcttatatcttctgtagtgtttaatacagtgcctagcatactgtatatggtcaaaaatggttataatattgatgtcagtggataattcaatgatcccacctttgattagcaattttttaatttaataatctttaaatgcctagaattaatagcaccattctctcagcttctatacccaggataatttctggacacttctgatgactttcccatgatctccggaaataataaaagataagctttacagatgaggtaacagatttgcaaaatattaaatatgccattacctgaagagggcgtaagttgagccctttccttcatctctttcttgctcacagatattacaatatctgtgcaaaaatcctaatgcaagaatgagcttagcatattccagggactgtcattaactgaaatacatatataacaaggaggaaaagatacaataaatgtggaatttattctaattacaatggaaagcaagtggagagttttaagtaataagttttatgctttaaatttttttggctgctgcatggaaaagttccttgaaggagaaaatgtgaatagagagtggtgggaatggcagaggactattgcaagagtccagttggttgctgatgttatcttggactagggttatccgtgtggaaatggtaagacaaggtaatattcagacttgccagtgtactacctgtgggtgtgaatgacaaatgtgagattcaaacccaggtctatattgcactaaagtttacaacatttgcacacctctatattccctcaattgggtatcttgtttactttttaaaaaaagacaatataaaacttataagcctagtttttcttcaggttactttgttgctttctgatttaccattcttatcgccctaaaatctaaatgtaattttagagaatatagttatacattgaaaatataagagcatgcatgggtacatggaaattaagtatcttgagagattatatctattctcaaatttacccttgacaatgcaagcagttacaccaaagagatgaaccaattactgtaaacaagacagaaagcacgtaatctttatcttttttctttgtataaataacttgcagcattccagacgtctctctcattgcaaattgatataaccacaaaaggattttgagtataatttcaaggaacatttgtttgcgatcatgcttcccacctcccaccaaaaataataataaagatcatggctagaactaacgctccaagaggtacttttaaccttaaggaagtgtagactttaaaatctattagtgaggcaaaacaaactttgtttcagctagtgctagagaaatcagacccctaccactagagaactataatgcccattaaaaataaaaattaaacacaaattgtgacattaaaaaatatgagtgcctgggtctcatttccaaaggttctagttcaactggtttgagatgaaactcacgaagcagtatttaaatttttttctcagatgattttaatgtacaaataagattgatgagaacagggcttgaggaaaataaattatgttgtcttttttttataatatcttaggatgggaattcatcctcattttccaagttaaaataactgtcttgctctggcaaaactcagacagaactcatggaaaatacaaagttttcatctgtgtgtgtgtgtgtgtgtgtgtgtgtgtgtgtgcatgcacccagaaacacacatgtaagcacacatgtagcaatggtttaaaagaggacttttagagctctacagtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataagagcattacatagttaggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaatagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattcttatttgtattctcatatttaagagtaaaggccaggcacagtggctcatgcctgtaatcccagcactttgggaggccgaggcgggtggatcacctgaggtcaggagttcaagaccaggctggccaacatggtgaaaccccgtttctactaaaaatataaaaactagccgggtgtggtggtggacacctgcaatcccagctacttgggaggctgaggcaggagaattgcttgaatccaggagacggaggttgcagtgagccaacacagtgccactgcactccagcctcggcaacacagtgagactctgtctcaaataaataaataaataaag

SEQ ID NO: 868 - DNA, 92588 bp, Homo sapiens
attactccatgttctctgaaaatctgctagtcattgaacttcatcattttccaaaactctatagaagattagcattcttctctgcttagagacactgtgcctggcttatacctccatcaaactctgtggcccctcttacattcatatcaggagctcctaagccaccgatatgatgtcagtgggatccacagaacccaatttgaaaacatatggtgtatacattatgacagtgcactgaaaaagattgtttaagattctacaagtaatcatattttgtcaagtttggtgaggtttaaaaagcataaactaaaatatcagacagcagtggcatataagttggggaaggggtcaaaattcagcaacctaaatcttagattatttaagttggagatattaatttcttaaatttgtctgcatgttaaaaaaaattcaaaggcaatcattaagtaaacgacataaaatgtgtaacttccattccagaaaaagagaaacaaagcaacaaaataatctggataatccaatacgaggaaggaaaggaaaaaaaaaaaaagaagcaaagaaatgtattatcagtgatgttctagagccagcttatagtctttcagcagctttcaagagctgctatgcacatctcttttcatcttttcaaatctacttcagttacttcatgtcggttgcttgaattctgccatcttgacagtatttacatcaaggaaataatcaaatgctacaaattaataatcaaatgcttttgtttcagagagcctgtgttttgtatttgtttagaagatatccacataaaaatagtagagttgaaaaaatatgaacttgatgttgagaactagtgacactgagcagagacaattcttataaggaggtagcttcaattgcgtagttgttacagagtggcatagggccaaggagaagttgttttataataaggggaaaagcctgagcatgtttacatgtagaagagagggacctagcagaaaaataaagcacacttatgatactgaagaaagagaacagaattgataaacagggccttgatgcattgactgaattaagaacacaaatgagaagaaaagaacagaacacaactgttatgtaatgggaggagaggttgaatgcagaaggttggtgtttctagcaaatatgggtataaggcaaagtccaatgtaaaactccccatatttagtacaaccacatcctcacatttctgcttccaacaaaatttgggctagccaagcaacagcagcttttaagatgagatagaataaaggtcttgaaagaacagagtgtggatactttactgccataggaaaccacagatgttatcttgatgtccaaggcagctgcagaactaacagcatgggcaaaaattgcatcccctgggaacctacctttactgtttctccctttatcatattctcattttttttctctctctcttgttcccaaccctctcctatggaacactctgcatcaattttcacgtgaggatcacatctgcactgaagtcactaggacaggcagaggttgctgcagttgcattgatggctctcgtccttaatgacactttttttttctcatcaagatggaggcataatgatcttgaagcagcaaagggatcaattaagatcctgatcccacttcccatccttctattcaggctggggtgatgggatttagaggaagcattgagcataggagagatccagattttattagagaaaataaatggaggtcatattcagagaatggttgaggattagaggtgtcaaagaactcagctgaaatattcaagagagaggagaaaacaattatttgagggaaaaaggaagcacattaccagagtaaagcaggaattagtggaagggagaaaagactccagagactttttttcttggatactaatcaaaggaggatagatgtgagatactgcatttttctctcactactaaatgataagatagcggaagaagggatttggtatgtattgctaggttctcgagatagcactgggaaaactgaaaacattctctaagaactcctaaagaatgtggtccctagtctagagttgtgatctccttttcacatgattaaagtttttgcttgcattctactgttagagtgattttccccataatacaagtatttgacacactggggaggctgttagaaataatttaatgtaacagcttaatgtccttcttgatttctgaaagatatgtgaatataattatggaatatttttcttgatccaaacaggaaatgaccaaatagattggggtgacaccacttaaagaggaaaatcttgcaattattctcctttattgaggcaaaagccgttacccacccatctccttttcaaggaaaatgttgcctaggatttgggactccagatactagaagagttaggaagggtatccaatcactatggccttcactgtttgactgtaaaatgaggatgttgggctggatgatctcaaaataccttgtcacctctagaatcacagtgattctctgtgaccatgtgcccctgtataatgagggcaatcatcctaaaccttcttaagagagaagttattcttggcgtgaacccgggaggtggagcttgcagtgagccaagattgcgccactgcactccagcctgggctacagagtgagactccgtctcaataaaaacaaacaaacaaaaaagaaagaagttattcttaagagagatgactcataaactaactgcttcctcacaaaacagctgctggctagacattagaaaaaaactttaagttaattcatagaactttagagctagaatagaccagtactagcctgcaacctgcctcttacaggtgagaatatagtcccagattgagttaatgacttgcttaaaggaacacactgattagtagtgcaatttagctttttgctcatgggctatagcatttaaaacttgcctctgatatacatattcggtgagctaaactgaactgctttttaaaaagcttgtacactttttatataatttctatttcatagagatttaaatagaaaacaagatttttaataaggagatttaaagaggcttcatcacagcagcagtacataacattcaatctcctacagtaggtttttaccagtttatttctcatcacacacaggagttcattagcttgggtgagaaaatgacttctatattcaattaaagctcactgtccatctcattttaaatgggattgtaatagaaaatattgtaccaggtaaaacttcaggccaattctgtgcagattgcagtcaaattgagtatgtttgaggggccataaaatttataattaagcttatgaaatatagatggtttctgatagggatgcttcacaacaattgattgctttataagccataataatttggaataggaaatagaataacctcataattaagtattgcttcttttcaacctgaaagtagtgattaaaggactactctgattttataattctctgaaatatttagatttgtaggcaatggtgaaatgctttttgatgcatcttctgaaatataaagtgtacaaagcaaagtgtaatcacatccaagaagaacaagctgcatcttttcttttagaatattttgtgtttgtctccagtagcattttaattttattttagtctcgtggactgctctagctgggacactgtttgcaatgtaaggaatttaagattttaattttgttcatgacaaaaaaatggcatttaactgatggcctttgataatcagagtagaaaagagtggccatactgaaaaataaatcactaatcacttcatttaggaaaacactcctgaagcaaagctatagcaaggtagaaagtgaatataaatcaataaaatattatgtgaagtttagcttttagggaagagaaaataggtaactttcactgtctatggtatagattttacagtaaacaataatagcacatctaaggaggcaccacttacgttcaggtacgtatatgtacattgtacacattgtaagtgtgtacatttattgcaattttcctaatatatatttttgaaaaggaacactagttgtaatccaatttttttttttacagtttgaaagttccaaaccatttttacaatcaacttcaatctctgtgtatagggtgagagggggtatgcatatgtgtctgtgtgtcagtgtttcttttagccttatgttacctattacctcaacacaatttttaaaataagaacgttaaatactatagaagttaagcgagttaatctatcattaactgggataccacagcaaacatcaaccccaatcatattttaaataaaacttcaaaacaactccttgaaacaagcactgtagagttaatgaaatgaaaatctatacatataaactgcagaaaacaacattttgcattattattttaacgtttaaaatatagaaactatagtatattattttcattcagagaactgttcatgggttaacacaatttttcaaagaagaaaaataaaagtgaatctgaactctgtcatttagaccaaaaatgttttaaagaaatgtcttattgaagtccacagtgagttctagaagtagaactcatttgtagctaatattaaaaattctatttgaaaatattactttgccttagtattagaaagatctctaagattcactttatatagttttacaatttaatgaaacctaatgctgtattagagagagtggaaacgcgaagatatcctctgttgtattctattttgtctttaaagttatcagtattgtatcacacgaatcaaagttaaattggatctctaataggcattttctcttgctaacaaaagcaactgcttagtgtttccatttaaatgtgaaataaatcaataatgtgatataggcaaggaagaagaacatgctcacaaagacaacagatttctaaataatgaaaatacagtcttgggagtcacatgcaccaatatctgtgatgccaggagatgtatcaatgatcatactcttgaagattgtgatcctgtcaccatgtttactaccggatctacatctgagattgctggctctagaggtaccatgtgtgtgtggattcagagatgtattcatcccttatcattactcatttaatatttaagcaaactattctacctctctgggtcctctatgagaattggaaataaaaacaaaagtcacacaaaagatttttccaaagtgtgttatacagaatgtaacttcttatgatgtaagtaaagaataagtaaaaaataaatcctgtattgaggtatgataaagaaatattaaacaagtttcatttttcctttccattctaaagcacatttaaaaattctaagagcacaatatactgtgtggcatttctcaagtacacttgcatgtggaacttttaacagagtccttactgaatcagcatttgggaaatgctattgtaaataatggctcttacaaattgtagaagagcaaagcatctggaattaagaacccttttttctcacaccaaatgtattagtgcaataaacatttgatttgtagttagtaatacaagtcttaaaacacagaagttagaagacttactttaagtcagattatctctgaggaatccagaggcatagcaagtggttgaatttattattctagaattatattgtgcccaaagcccaattgtcttggggttacgattattacttgatttattagacctaagtaatattggaatgcaaatatcctggagaaatatcctagagatatgtccaaactctaaaggaatcagctgattatgtaatataacattatactaaagcctaattcaggatgttaaaacatatatagtatgattatcaacccatagagagcaaaagttgttaatgcagtctacccatatagaaataagggtccccaaggggcaacttctggccctgatggcatgaagaggttagcaaatcctctgccccttcaataaaacataaaactatagaaaattatccacataatttcaaggatctaggaattgatcaaggcaagtaacaactcatgaagtatttatataggaaaacttcatagaattctatgtaagaacagtagaagtctgttaactttattgatgggagctacttccactatctagaagacaccacattctagaccacagaacaaattcccataaaattaaaaggattgaaataatacaaagtgtgttctccaaccataataaaattaatctggaaatcaaaaatagaaataaaaaggaaatctgcaaaaaagtggaaattaaacaatgtacttctaaataaccgtaagttaaataagaaatcaaaaagaaaattgaagatattttgaagagaatgaaaataaaaactgaatataaaactatgggagactgaaaaaccacatttataggggcatttaaaattttaaacatttatattaggaagaaaaaatatttaaaatcaattattgaagtttttacctcaaaaaaagggaaaataaaatgtaaaaacatgaaataaataaaagataattttaagttacttaaaaatttttttcttaaactcctttcattcatttcttcttgtattcttaattttatagctctttacagtaagtaggaaattttgttactagccattccatcattaccttatacatgcctctttatgaatcactctttctaccaagttgacaatgatacaaacaggaggtagggaaatactgggtagaagagtgccattccctggcaaagattccaccctcaagcctggaaacacacagccctaaatgagaacaggcattcctattttcgcactcaaatgtttccttttccaacaccactctgacctaccatgccccatcctgtgcccatataaatcccaagcttcaatagcagagcagcacagcagcacagcagaggaggagagaagagaagaagtgtctgaacgtcaagaggagttcagctgaggacagtcggagtggaagttggctgtgggatagccaaactcaaggagaagatcatcttcccactctatcccctctccaccttcccatctcactgagagccgcctccatcactcaataaaatccccggactcaccatccttcaactccatgtgacctaattcttcctggacgccagacaagaattcaggatgcactcagtgtgggaatccaaaaaggctgtcacactgacttttcactgagtggtttaacatttaagctgtccctggacagcagggctaaaagaacactgtaatacccctagacattgccatggggctggagcccaaaagcactcaccccagctcctgcacctgctcacttgcatgctccccctcccataaggggtttgggtgcatggcagccaagtaaacaagccacacttctgtcacaagtcccatgaggggatcagggaactctcccatttcaataatagattggattgaatctactgaatacagtgagataaataaagctatgttgcaattgtttaggccaggcatagtgatggctttgtctagcctgatggtgatagtgcaggagaaaaatagataattgtgaaaaacatagggaatactattgatatgatttggtattcagtagcatgacaataaaaggcaaagggtgttacagaatgacaggtttctggcttagcctacaagatggatagtcatagtaaatttgagagtcctgtgagttttccaagtggaaatcatgacaaatagggcacatttacaacgataataacacagacagctccttgaactttagctgtaaatattctattttcagtctactttggtttttcattctgcattctgtgagctctgtaaggatgtaccataaataagaccacgtctaatttttctttttctttacaatacctgacatagatggagcatgtctgaactaaggcaacagaagtaggaatggtagattagggaaagaggagagattaaagaggcagagtcaactgaagttagtaattgatcatatgcagacaattaggacaaaggaaggagactaaagtgattccccagtttaaggcatgggcatcttgaaaaatggtgggacagttggttaaaatatagattatatgagcagaagcagtcttgaaaaatgtactgagtgttgttttgataagttgagtatgtggttatgttcaggtgaaggtgaaaagtaagaagtcagaagtactggcctgaagtttgtaaagtaaatccgagctacagatacagtattggaagccagtgtgtatggtggtccacaggtgtggataatataaattaagtcttgggtttaaaccaaaaagaagagttctaaatggaaccttgaggaaccattatttaaggtaataggtgtggaaaagaccgtgagctcagtgaaaagcattgaataagtttaggaatgagtaaccagagatgaagaaaaaaaaaaaaagcagacagcggtgctatgtttcattgttttttaattttataattggtaatttccacttttattccttatttgctgctgtgaaatgtcacacaattatttaggattctgaaaatagtggaattttctacttctacttaatttttctcatatcctttttgaattatatgctcatgaatgtttttacattgtaaataagtcagtaaatacacacacatatacatagatggggaagtgagagtgcttataaaagaaacccaaaagtttctttctgatagggtatatttcgaagaaagtttgagaagtactagtctatgcctattacaataacctcctaagcctgcttgtaaaattacacctccagctaaactatctttcacagtattactggagaagactttttgaatgtctaatcatgatagttttctgtacagttatttctgatgaatcactaaagtttaaaactcaatgtccttttcattgtaacccaccctaaatcccacaattagctccagttgtattttttggcgctctcttcccaggggtcgagtgctttctctgtttctgttttctctattttctgaacataccctgatgcccttaaaaatttgctgttcctttagtgtcctctactaaaaatttcctaataaatatagccttcccacatcccaataggcagaactgagggttttttcccaccatacaattcccaccatacaaaggacatttaactgtaaacattcaccactgtgcccatgcacatcccatgtgtgtatttgtgtttatgtctgtctctctttctaactgtaatcccagagaaggaaggaactattttcttttttttaaatttcccatacatcttaatggcaatttacctacttgggtttttaaaaaaaggatttttgagttattttgaattgaatcaaaagtatgatcaataacttattcttagtaacaaagaataagaaacatatcttgttagttacttgtttctaaaataataacctgtatgcattagccgtggatttatattgctatttacagctctcccaatgcttctagctttagatatgagatcacatctgaaaagatctcatggacacttgggaacattttcctggaaaatctttgcaataactttattatttgaaaacagtaatattttttaaagtgtcaatttttattttattttaagccagatgtaaagccctcagggaaataactgagtcatattttgtcacttgtgaggttcaaaggacatctctggaaattgacatacaaatatatcattattatcatagttgcctctaaatactgtgttacatttaaatgtaaatgagttcttatgttatttacaactaaaatttcactaaattttccattagcctagttttgtcttttttagagtttcacaccacaagtatgagaactccctcaatgaagaaccatagtaagggagtaaagaggtgtgactctccatcagttttattgacaatatattccctaagattagaggtcttcagagttgttcaggcagcaaataaaatactagttaaacaaatgttattgataccatccttacaaaacaatgaaaagaattattcgtttgtctgaagaattagatgaataggttccattgaaattttatatgttcagaggaatatatgtgcctattttcatagtaataaatagcacaatttccccaagaaaatgtgggattttaataaattgtgcttctggtttacttctcagtggggctgtggtggcttcaggttcatgacaaatccaattatttggttgttgaactaccccttctggaaagcaaaaataaaaaataaaaatccatgagagaaaagaaaataatatgaaataatatattgaatgcctcaggcttgctgctagaaaatgtgcgtgtattttcttattaagtgctcacaaagctatctgttgtcaaaatgcgtaacttaggaaggggcttcaggatgactgaatagagaggcgtcttgtatacatcctacacaaaagaactcatcctacacaaagaacacaacagggattgacagtgagcctggagtggctcttcaatataagcaaagggtaagtgagacacacccaccagtccacatttccattctggatcctaaaatcctagccatgggacaacccctcgaccctcaaatgccttcagactcacatagagagatgcctggggaccacacaatggcattgctacagagaggggtctcacactgtgttccacacacctctgagtcctaggaagctatatacccaattttgacagctcagcccccatgagattacagtcttctctggggcccaaaagctccggcatttccacatccctggagcctctttgacatcccttgcccacagccactatcttggatggctgctgctgccagggttatagaatgagtcattggcagtgatccagcaatttccagcagcaaaactgctgctcatttacatcatctgaggcctttccctatgaaagcgaattttaaaaattggaagaagcaactgttacacctgatgcacacatgtcaacataaggacataagaaacatgaagagtaagaaaatgtgacaccttaaaaggaacacaatacttctttgacaacaaattctaatcagaaagaaatttataaaatccctgaaaaaatcattcaaaataaggataattaagaagctcaatgagataaaagagaaaacagacaatatagaacaaatcagaaaaaaataattcaggaaatgaattagaaatttaccaaagatacagatcttaaaaaaaaaaaaaaaaaaagaaagaaacaagcgcaaattctggaactgaaaaattcattgaatgaaatacaaaatacaatttaaagcttcaacaatagactaggtcatgcagaagaaaaaaacagaacttaaagacagaccttttgaaataactcagacaaaaataaattgtaaaaagtgaacaaagcctatgtgacatacggaatacaataaagcaacaaaatattcaaatttttggtatcccagaagataaagctataaattaaagtggcagagaccatataatggaataacagctgaaaacttctcaagtctagcaagattttagacatccagatgtaggcagctcagaaattgccaaatagatacagttttaaaataccttctcaatggcatatgccagtcaaactttcaaaattcaaagacaaaaagagaaaaacagcaagagaaaagtctgtagtcatttataagggaagccccatcagactatcagtgaattcttcagcagaaattcaggtaattcagaaaaaatgagatgatacattcaaagtgctgaaagaaaaaaaatgactacaaacaaaggatattatactcaacaaatctatccttcaaaaggcaaaataaagtctttctcaggcaagcaaaaactaagggaattcatgttttgaattgtaatatactcttgatgaattcatccctttagcattatatagtctttttttctaaattgtctttttttctaaacactatattgtctttttttctaaaataaataaacacactatattgtctttttttctaaaatttgttgtaggactagattggtcttacaagaaatgctgaagggagtcctgcatctgaaaacaaaatgataaaatttaccatgatagaaacacgaaaatataaaatccgctggtaaagcaaacacaaataaggaaaagaaaggacccaaaaattatcactacaaaaaaccaacaaaccatgatgagaagcagtaagaaaaaatggaacatgagggacttttttgtttgttttcttctatttgctaaggttttcctctaaccgtattctgccaccaatgccattttccaaataccaccacaatccttattaatcagacacactctcctttgaatttaatttaacaatttatgctttttgtacattcgcttggagccttatacttcatcttaggcaagtaatttcctacaagtcagtccagtgttctcaatcctgtgtcatattagagagttcttacatataaaaatatttcataaaaaaattagatttgacatcagtgaaaagtggatgaaaaatagtttattctgttttatgggtgcatatgttgctatccacatctaggtgtgcatgaaatatttatctggtgtttcctagaccatcagaatcaagaaagagttttgagagttgtttgagctccaataatagcaacagaatttgtagattcttatccaatgctccaaactaatggttttactgcaagaagccagcctttatttaatctttggagcacagtgataataacactggttctggaggcaggttctgttatgtatagctctatacttttggaaagggcatttaagacagttttcctcattaaaaaaagcatcagtgataataatattatttatctttgatgcctttttttgggatggagtctcattctattgcccagactgactggagtgcagtggcacaatcttggctcactgcagcctctgcctcccgggttcaagtgattctcctgcctcaaccacctgagtagctgggactacaggcatgtgccacctcgcctggctaatttttgtatttttagtagggacaggatttcaccatgttgtccaggctggtctcgaactcctgacctcaggtgatccgcccacctcagcttcccaaagtgctgacattacaggcgtgagccaccatgcccagcttctttgatgcttttaaatgcatgtataaagtgctttgcatgtgttatgatgttaaccattatgtctagtgggtttctttaactcttgtttttgcattgcaggtaaacatctgtactctctgtctgtctgtctctctctctctctctctctctctctgcctccctctgtagagacagagagtacataagtatatatagactatatagacagattatatatatagagagagtgtacatacagagaatacatacatatatacatatatatgtatatatgtataaagtgctttgcatgtattataatgttaaccattatttccagtggatttctttaactcttctttttgcactacaggtaaatgtctgtactctctgactctgtctctctgtctctttctctctctgtaaagacagagagtacataaatatatgactctatatagagagtatatatatatatatatatagagagagagagagagaggaactacagagaatacatacatatatagagatgattagataatactctatattagataatagactattagatatgactaataagattaaaacctctaatattagtgcaaatttagtacaaatgtccataatttcttctagtaatcaattacttggcttttttgtctctcagtagctttatacttatataaataatacaaatttttactatttatttttctacacattaatagattcatttttatatgtactcctttataattcacattattgtctaatttttgaatgaatgtcattgtatcttatctgacaggcatacaaatgtaaattttgagggtatatgataatatttattttatgaatactggtgatgatgatgggcatgatagtgacaattatgatgcaacggtgatgatgatgtaaaaagtaatgatgatagggatagaagaaattggagttgcaatgctagttaatattaattttttcatatgttgagttccagaaaataaaatcaagtgcttttataaattagcttaatcttctcagaaattccatgcagtaactaagatttattttttaaaatttagctttagagatattaagaaatatgcccaaaataacttatagcaggcagagctttgattctaattgagactgcctgactccagagccaagtaggctaatgacagcatgtttagttttcattttttttttcaaatgtcaagaaacatgtttaattaaattgagtcaataaagcagaattccctgtagaattctctcatgccaaattgggctcaggccattggtttgaacatgttttaaaatcacctagaataatatcgaggtatatttttgtgaaacatcttgttttgttataaagaacctcttctttaaatgcatgaaataatgactatacattattgttagactttttcttccatttaatttactataatatcccattacctcagctttcacttttcttgctgaacatacatacagcatactttggttaataataagcataattttaaaatagaatttcagaatacttgttgtaaaaggtgacagggactgaaagaagaacaagcatcaacaggaataaaatttaaaacatattttttggaaatgaaattttaggaatgattgataagtgtttctttaatttctcaaagccctagtttcctcatttgtaaaatgattataataatatatgtctcatttaataattgtgagggcaaaagttacataattgttgttaagggctgaattgtcttgccctaaacttcatatgttgaagtggtaacccctagtacctgagaatgtgtctgacattctggacaattaactttaaagagttagttaagttaacattaagctatttgtatggttctaaaacaatcgatttgtccttatttttgaaagagaattttgatataaaaggggacaacagagacacacgggagcagtgagataagcgtgcgaagagtaaccaagtgagcagccatctgcaagccaaagagaaaggcctggagcagagcatcccatttttgtcctgctgacatcctgatcttggacttccagactccagaactgtgagaaaataaatgtctgcggtttaagctacaaatctatgatattttgttatgttagccttatcatatgaatatgatagtatgtaagtatatactatagacaccacgtgtgtctaattatgttcttctgtcagccattagtgtgacaggttaagtccacccaatactttgtggagttgcttttggaaattgttactacagcttccttcagaccatcacaaatttccaggatcctccagaaatagaatgctgtaacgttgtgcttaatgttacttctagtttgcccaagaatttttctcagcattcctgctccaccagttttcagcaggacctctgtgcccaaatcacagaaggttctctctgcaatcttgctcctcctcattggcagttcactgttatattttatatgtgaaaaaatcatgatagaaaccgttggtagttcccggttctcccggtctggacttattctaaatcagaccctgttcaccaggccctgtgtacctggctcttctccctaattcaaccaaactctttattgcgtgtgtggagggtctcagaagagagaacattttctatccttccctcagtcatagcagtattggttggtatcagtacagcattctgggtccaagcttctctctcaggggcagatagattttcctgctctctaggtggcaatatacctttgcatgggaccaggatcagaaggatttgttggtcttcccacaaaagtagactacactgagcatacagctcgtgggattttctttccctctcttttttccttccccagcaacagatgacttgcttcgaccccttcccctctgaacaatggatctttgcctgccttctattcccaagttgcttgaggcttttaattcatataataaaagagctcaagacataggcaaggttttgtgcccacactctttttccttccctgcctctaatcttcctcatgagtatatagtggaggcttatgaaaagtacatggcaaatgaatgcacactttcactgggtctggagttctcaaaggttctaaatcgtcatgctagcccacaatcaacttctaataaagtactgaaatgtaattgtttcctctttcctgcttgtacagtgtttttgtcccatgttttgccaaaggtgaaacattcgtctgttctctctctcctcagaatggcctgccattctggaatttagtccacctgattgccttgagatctgagctctgatatgtcaaaaaatgtgataattttgaagattatctggccttttcttcttgccaattaaggtgggagtgatattctcttgtaggacatcataaatagaagcacaactctctactgacaatcctttgagaagactccaaatatgaatacctgaatatgctgagactgtagaatgcaagagtataaaaaagcaaaaatgtactttttatcagtaaatccaataaatatatttcataagaatgatatcttccacttacaatgtatgtatatattatctaagtatccctagtgattatatgtagaggtcatttaaaagttaagaatgctcaaagaggttttggaactaattatatttcatctagaattatgtatttcacagttatacttcaaaataaaatcatcatggtagaaattgagtgattttgcattatgaggagacatcagacaatcaagacttgtttgtttgttttcgtttttgaggtggagtctcagtctttttttattgttgttgttgttgttgttgctgttgtttgagatggagctcaggctggagtgcagtggcacgattttggcttactgcagcacctgcctcctaggttccagccgttcttctgcctcagcctccgattagctgcgattataggcatgcaccaccatgcccagctaatttttgtatttttagtagagatggggtttcaccatgttggccagactggtcttgaactcctgacctcaggtgatccacccaccttggcctcccaaagtgctgggattacaggtgtgagccaccatgcccagccaagacttgtctttttgaagtaagaataatttacctaacccccagagtatctccaatacattctgaaatttatcagatagccagccacaagagagatacaacattatatatccaaaattaaaaataaaaagtaggataaacttcattattagacaattagaagtatatgcccagaacatacatttgtaaaactacgctataaaagtaatagaattcaacaggctgaatgttagatctataaacctagggtatccattcactagagaatgaaacaataagaatagtaatcaatgcctcaagagaaagctcaatatttctaacagaagaaatcctgcatatataacaaagggttactagtggcttgagaaactccaggaagcctatatagagaatgttttatcaacctccccactgcgaatgttcctgtggaagaggaagcacaggaaagtactgcatcttttaaaatcttgaagcagggactgaatatttactctcagggggtggtacacttgcaataagtattttgttatattaccaaaagaaaacaatctgaggtacaaatggtaagaaaatgttagattattcagaaagctctaaattctggaattttttgttaaagcttctgaatatctgcacatctactaatataattttagtaatatgtgtgtaattacaaacctgcaaatttgttgatattaccatgccaataaatgtttccaactcagcatttcttaaaatatggataggagaatagaaaatttatattcctccaacttctttaccactttatgaattttagtaagatagaaagcagcctaccctgaacacattttaggaaaacccagcttttcttctgtattctgacaagggaaaaacctacgaaagtaaaaaaggctaccgtctctcttgctcgaggataccacttacatttagttcaatcacaagaacagataataaagggtaaattgcaataggcaatttgccactttcctatgattaacaatcattacattgctcattgctgtgccactgtgtctgtgtatataattgtgtaaatgtttttttctgcttatccatggaatatatctagacaatttgaaatctactacctgcttgttcactactcctattgcagctaatctcttgaatgttaaatttaacctgtctatttaaagtcatgatacttgataataagtactacatttatgaagcacttattacatgctagtcatttggtgtacattatccactttaattattaccacagctttgagatgcatgaaatattatgatctttattttatagattagtaaaatgaggtttacagtgtttgtgtcatgtccaatttcacctagctaagtaatagatagaagaaaaatctgatctgatatgtacctgattactatgtatcttttcctacctcttgcactgtaccgtctcatccctccagcaagaatgacttcaaaagtttacttttgtctatttaacttggataccaataactatttcttgactttgaactacataggaattttttttttttagaggaattttgctcttttgctcatgctggagtgcagtggcacgatctggggtcactgcaacctctgccttccagtttcaagtgattctcctgcctcacctctgagtagctgggactacaggcgcccaccgacatgcccagctaatttttgtatttttagtagagacagggtttcaccatgttggctgggctggtttcgaactcctgaccttgtgatccacctgcctcggcctcccaaagtgccgggattacaggcatgagccaccacgcctggctgcataggactcttaatagtctcggacagtggctcatttctctaactattgcaaaattgagttttacaatccatcactctatatttctcaaccaaacatcttctctttagtaccatcttgtagtcctccaccatcagctgctagttattccatatagctgagtcatttaaaaaaacacagacgagaaactgaaaccacacagtcatattgacacatgatgggcctttttggataaatacaatatggcctcaagtccagattgattccaagcattaattaagtgcttatgacaagaatgtgtttgaaaagaatggattttatttggtacatgtagttttaataactacacttctatatttcaagccctaggcactatagctgcattcctctgagaattttcctcatcagaaacattgtggaattaggtactatatgacatctggtgtaaaatcaaagtatttctgagaaggtaaaatgtgatattattcaactcaacttgaaacattttaaaaatactcctatagccctggaaactttgttcactaggccattgaatgcatgctattttgacgtaatgtcactgaagagacaggagtttgattctacactgaaacgtcaactcaaatttcaatcattgttataaatttgtgcaatttatttgcattttttttctaaatttcaggaagtgctaaaagcaaatggggcaaaattatgtagtaaatccacaagttttgtgctctcctaactgcattgtgcattgtagcaataaaaaatatttaaagagaaaaccaaaagaacaaacaataccctagaaaaagataaactttttaaaaagctgaaaattgaatataaaatacaaagaagctaagacaatgaagttaaagattgccgaatgtcaggtttgggagaacactgtagcagactgaggttcagtttcagaggattaacacggaccaaaagtgttcctatgcctggagtttaatttagattcattgcttaaagaaagaaactaagaacaaatgctgctgatggctacctgtggcaaggactcataggatcgtgtgggctgaagagatgggaaaatataaacacagcctcacagaagaaataaactaagtttgaatctgtaactggctggatccacaatatccacaaagcagaaaagccaaaatgagagacctgattccagatgctgattctactggaacatgttcaaacaagcctctatatagaagatcacatggaaggacggagggagataagagaaaaaagaaaggaaacagagagagagaaagagagggatccttttcaatcaaatgagtctgcaaacacaaatcctgaattgcctgaagaaagatgcacacaaacaaaaatcaacaattagaacattaattcattccatatgaaattgattataaatgtttcataaacatattaaatatatttaagttgctttaaaggataaattaagatttggcattgataaacaatttttaaaaagaaataaaaaaaacagagaaaatgtgtataaaatagtacaggtgcatatgaaaagaacctactagaaatcctggggaaaatatagtcattataataaaaactctgttagaataatggcccccaatgaatcacaaccttcttattttacattcttttatagtatgagtttcccatttcttcacctctttaattcagcatggctttgagatttgcatagactgacagaatatgacaagaatgatattatgtgactttttatgctaggccttaagagaccttgaacttccgccttttctgtcttggaatgaatcttttgtctcgtgaataagcaactctgggctcctatgagatgagaggccacatagaagagaagtaaaaagctacagacaagagccaacaccaaccaccagacatataattgaggttaccctgaaataaacaccccagttaaggttcagataactgaagccatatatgagtaatcctaggcaagatcagcataagaactacttagataagctcaacacaagttaaataaatatatacttgttttcagacactaaatttggaatgatttgttacacagaaattaataattaatacaaacattggcaactagaaacaaggtgctgccataacaaaatcctaaaagctaggcattggctttgggaccatgtagtaggtggtctatagaaattgctatttatgtctgaaaatgtggggatcaaaactattggcaaaacttaagacttaaatagattaaaaaaatgtatgcaatgaatgtgtagatatagccaaggtgatatcccgacagaacaatgaaattgacagttggctttttgtatctgtctataataaataggagaggaggagatgaaccaaagggagtatgattcatttggaaagcagaatttagaggaaatataaaggttcaagatgtgctgggttagaaaataaaatcatttcatatttctagactttctagctgtggtcttagaataaaaatcaaaccaagtgtgtggtgataaaacctttagttaagcacacagagaaatttatgatagtgatcagtaaatccttgcaattaggcaaagaacttctatgagtttcaagggtattatctcacaaacaccttacaaatggcccaatgtaagtagaggtttatttgttaaatagttatggatgtggcttttgaacacggagggaatctcaattagattcacaaaaaattcaaaatatttaaggtagttataatgtctcatccataggaaatagagacagtttataatgaaaagaagactctgggaccccaaatctctgtggtcaggaagcagactgggaatcccctttagttgcaaacacagtccatttattatagaaaatgaaacaaatcttagagcgtggagaccagttacctggaaggcaaagtcaagaactaaggagatcaatagttaggaaactattcagccgaggaataattgggcccttactaggatgtgttttcttactatggagaagaagactcttacaacgtatacatgtctatatttcagaatttgtaagaaccagtgacttctatatgcctaattccatttcttctctctttttttttaattggaagtgtctattgcaattattctttccctgtcttatcagcacatgttgggtatattgggtgttgataatttattatttgttatttacagttttattgaggtatacataaaaataaaaattgtgtatatttatggtgtatagcataatgttttgatatatacactgtgaaatgattatcaaaatcaagctaattaatatatgcatcagctgacatagttatgctttgtttcattgtgtttttttttttctggtgaaaacacttaagatcaattctcttagcaaatttaagtataaatacagaattgttaactatggtctccatgctgtacattagagctctagaactcattcatcccacataaccgaacttttgtaccctctgactgatattttatttccttccattctacccttgtcaacaggagttctggagggaacaaatattcagaccatagcaaaaggcatagaatataagaatgtaattgtgcacagaaattaataaaacatatttattgcttgatagtctacgtcctatatgcttgatagtctacatcctactcaggaatgcctgtagctagtgaccaattattattgcaatacaaaactcagctcctttgcttcaagtcacgatacacttagaagtataatttatgctccagagtttctcaaatgattaagcattcttggatgccaccaaaattgtatcttttctgggcttcttacctacccttccttttcctgcttccctcactcttacttgtttcttctggtagtacttgctcagtaaataacttgcacctaaatctttgactcatcatctacatctgtaagaacctgtcctaaaataaacatattagtttaagaaataactggaatttttactgacgcctagaatgtggaaacttggaaagagtattactcctacattaataacagtaaaatgtcagtttaaattttaaaaattataacttttcttgaatctgtcagagaactaaggtcttggggaaaccaattagcttggaattcaaggaaagtcaggtgtctccaagcagatgagatagacacactgaaacacatatggcagagaacaggaggaaaatacatcactgtcttgtaagtggttaaaaagaatttatcaatttttttttttcgagacagagtctcgctctgtcgcccaggctggagtgcagtggcgcgatctcggctcactgcaaactccgcctcccgggttcacgccattctcctgcctcagcctccggagtagctaggactacaggcgcccgccaccaggcccggctaattttttgtatttttagtagagacggggtttcaccatattagccaggatggtctcgatctcctgacctcgtgatccgcccgcctcggcctcccagaatgctgggattacaggcgggagccaccgtgcccggcagaatttatcaattttttttatctgaaaaagctcaagtatgggctagcataagagtatagaaccgctgggaggcatggatatcaggggtcttcataatacttgcaggctattctccacagacttctaatgggagcatgattggatacagaaatcctctaacagtggtgcagacttggataaggagagcattcatcgctacacaaacaagcataaatccccatgtaagaccttctcctctatggaacaaaagccttaaattgctggggtaagggcagcacaaaccatcacccccagggcacagatgaagatgaagctagggaaggtacaagaaaaaaacaaaatatctatccctgaggtaggggtaggaaactgtcctggaccaagttcattatatgtctcctaccactaggggaggggcagggaagtctcccatacaagacctagtaaagattcacagcaaaatttggcttctatcggcagatttactaagaaaatatcaacattaagaccaagcttgcctaagttttgaaatggtacaaaaataagaaaaaaatccttttgccccctaacaccaagatcacgaacaccaagtaataagcactaacagtctactactggagagaataagaacatgacaagatccgttgtcaggtgcaagagcaaaagggaaggccaaatgttgagggtagataagggacattaagaaaaacactctggtaatctgattttcaccctacggtattgctaaaagaattttaaactggttgtacactgaaggtaaccatagtaacagcaaaatcccaaatcagctaaactcatgactaggttgactccagtctccacataaacacactggcagaagagatgtgcatctttctttcatttttctttatctttttctttttcttttttctttttctttttcttttttttttttgagacagggtcttgttctattgcctaggctggagtgcagtagcatgatctcagctcactgcagcctcaacctcctgggctcaaacaatcttctcactttagcctcccaagaagctgggactacaggtgtataccaacatgcctggctaatttttgtattttttgtagagacgagattttgccatgttgcccagtctggtgttgaactcctgggctcaagggatccacctgctttgacttccccaaacagtgggattataggcgtgagccatagtgcctggctgcgatgtgcatatttctatgcaaaaatgctatttacttcagtctcgactgtacttttccttcatgtctaggattcagtattaaaacagaaaaaaataaggaaaaaataacccacttagaaaaagcaatcatatcaattagagtcagaaaagaccccgatgttaaaattatcagggaataaatttaaaactatgactaacagtttaaaagttttaaagcatagtttcctcatcttcaaaataattttttaaagtgtcaagtgtcaaattcttatggttattgtgcatattaaatcacataatgttagtgaagtgcatacttaacaaaatatctgacacagggtaaggatttagtaaatgacagtagttgtagtcattattacctgcaatacttaataaaatatggttgactgtccaaatgtgtttgtgataaacttggtttgaataattcctattaattatgcctttctagaaacttttgcaacaataaaataaatgctgcaagggctgattggttttatttcagatgttcctaagcatatctttaagccttaccctacccactccaagctgatttccatcactccccacctccttgctccttgcttcctttgccttaactatattttttgttgttgttattgttgttgttgtttaatcaggactaggagatgaaaggcagctgaacttcgttttcctctgtgatagaaactttgatattggtaactatttcagctctctattcaagaacactggaaagtttctggtcacaaaaaaatgtcagtgacttcactgtagtctgtaccttttttcttattgtagaactcaaaattctaattttccacttattattttatttatctctatcataaagccaaatattccaattaacaccacatagtaatttaaagtactattggaatatactttaaaattattcctatttcccttgaattttgtattgtttatgtaagtaaaattcaattataagtccatattcatatactaatcagtgatatccagttgtaatgataaatgttgtttctaaaactcttttatcattcaaggggcagaaactggattacagaatccatctcctttacccaacttttcagagttttcagctcccttttatttttatgtatcttgagttatttcttctgatagattctgtgccttgaaataatcttcaactaataaaatatttagaatttaggcaatagaatgtgtctatctgtttcaatcatagactctcctctccttgtaaccagactatatttatagtatgaatattattggccagctacccataaccaacacagatttttagtatatctaataccatcatggttgctgtagttctttcaaaatgatgtatcaaaattaaagttaatgacaagtacaatgtaaaagtaaggctgcaaggtatctctgtatttagctgccctgtgttgggatatctactattggaatcttgacagcaaattttactgctcattgaagattattccacatgcacttaagtttctctagctaattcattatagttcctcattaaattataattacttttaaaaataataattattttaagaaggtgaatccaagagctgttgatatcatgtggcttattttccccatttggtgaatgtattagttcgttttcatgctactgataaagacatactcaaagctgggaacaaaaagaagtttcattggacttacagttccacatggctggggagacctcagagtcatggtgggaggcaaaaggtacttcttacatggtgtcagcaagagaaaatgaggaagaagcaaaagcgaaaacccctgatgaacccatcagatttcgtgagacttattcactatcatgagaatagtgcaggaaagactggcccccatgattcaattacctccccctaggtccctcccacaacacatgggaattctggaagacacaattcagttgcgatttgaatgggaacacagacaaaccatatcattccaccccagcccctccaaatcacatgtcctcacatttcaaaaccaatcatgccttcccaacagtcccccaaagtcttaactcatttcagaattaacccaaaagtccacagtctgaagtctaatctgagacaaggcaagccccttcaacctatgagcctgtaaaatcaaaacaagctagttacttcctacatacaataggggtacaggtattgggcaaatacagccattccatatgggagaaattggccaaaacaaaggggttacagggcccatgcaagtccgaaatccagtggggcaaattttaaagcatcaaaataatctcctttgactctaggtctcacatccaggtcatgctgatgcaacaggtgcattcccatagtcttgggctgctctgctcctgtggctttttcaggatatagcctcccacccagctgctttaatgggctggtgttgagtgcctgtggcttttccaggttaacagtgcaagctgtttgtggggtctggagggtggtggccctcttctcacagctccactagtccagtagggtatctgtgtgggagctccaaccccatatttcccttccatactgccctagtagaggttctccatgagtgctccacccctgcagcacacttctgcctgtgtgtccaggtgtttccatacatcttctgaaacctaggcagaagttcccaaacctcaattcttgacttctgtgcatccacaggatcaacaccacgtggaacatgtcaaggcttggggcttccaccctcttaaacccaagctgtacgttcgttggcccctttcagccacagctggagtggctgggacacaaggcaccaagttcctaggctgcacacagcacagggaccttgggcccagcccacaaaaccactttttcctcctgggcctctgggcctgtgatggaaggggctgccatgatggtctctgacatggtctggagacattttccccatggtcttggggattaacattaggctccttgccacttatgcaaatttctgcatctggcttgaatttctcctcaaaaaatgagtttttttttttctactgcatcatcattctggaaattttctgaacttttatgctcagtttcccttttttttttttttgagatgaagtcttgctctgttgcccaggctgcagtgcagtgacatgatcttggctcactgtaacctccacctcccaggtttaagcgattctcctgcctcagcctccgaagtggctgggactataggcacgtgccaccacacctagctaattttttgtatttttagtagagacggggtttcaccatgttagccaggatgatctcgatcttctaacctcatggtctgcccgccttggcgtcccaaatgctgggattacaggcatgagctgcgactggccccatttccattttaaaattgaatgcttttaacagtacccaagtaacctcttgaatgctttgctgcttagaaatttcttccaccagataccctaaatcatctgtctcaagttcaatgttccacaaatctctagagtaggggcagaatgctgccagtctctttgttaaaacagtaagagtcacctttgctccagttcccaacaagttcctcatctccatctgacaccacctcaatctggaccttatttttcatatctctatcagcatttttgtcaaagccattcaacaaatctctaggaggttccaaactttcccacattttcttgtcttcttctgagccctcaaaaatgttctaacctctgccagttactcagttccaaagtcgcttccccattttcaggtatcttttcagcaacaccccacactactggtactaatttactgtattagttcattttcatgctgttgataaagacatacccgaaactgggaacaaaaagaggtttcattagacttacagttccacatggctggggaggcctcagaataatggcaagaggcaaaaggcacttcttacatggcagcagcaagagaaaatgaggaagaagcaaaagcagaaacccccataaacccatcagatctcatgagacttattaactatcatgagaatagcatgggaaagaccgaccgtcatgattcaattacctccccctaggtcccgcccacaacatgtgggaattctgggagatataattaggttgagatttgaatgggaacacagccaaaccatatcagtgagcccccacatcagtggcaaagttaggattgcaagcccaggtcatgtgactccagagtccattctcttaactactctgctatgctgtctcttacaatactttctaggccgtctaactgccactaattgtatgacctttggaaagacccttaaattatcaggaccactgctttcacatatgagaaatggggataataataaaaattattacagtgctgttttgagcattaaatgagttaatgtttgaaagcacttataagtgtttgacacactataagcactgtaaaggtgttggctaaaatgagttcttttaaatattaccttacaattatcttattggtatcagttaacgtttttataagtagattaaaagtttgtacaatttataattaaataaaagaataattgttagtccgtggctggaataagttaggactttgacattaaaaccccttatagttgtgtaattacttgcctgacaatactgagtaagcatgtggctactcaaatcctttataaaagaaattctcgtaatttagtgatattacttatgataggtagcattcactaggaatttagtatgcttcacaagctattcctaatactaaagtattaattctaattaccagaataattccatggaataggtactactattatcaccattttagagataagaaaaataaagcacagagaagtagctccaaattcatagagtaactggtagagatgagacggaagaatttatcatgtcctaagcacttccaatttagccagttttccactcttttcttctcccagcatcgtaaaatctgactgataagtataaataaggaagaaaaaataacatttattctctacaatatagtctcctcactacctgatgctaaatatgaagggacagttctaatgaaagtgatcaacaagttctagaaggaactaaagcttagttccttcctcaacctcagtgaaaagaacaaggttattagtggcgatgtttttcctaggtgtgggggagctaagcattttgaacacagcaaagataaggaagtcggtctgtaatctgcaaaaaggtaagacatttattaaagcattaatcttacctagactggcttggattttcacagtgatctcttgctcatcatgcattttaacaccccttgccacacaaccacttctaaattcttcctctaaaggtaaagagctgtatgttctgagagtaaggaggaaattcctaaaaaagtatctagaatctagaaaattattctctaggtttatgcctcatacatgattgcaaaccatagtgatgatgagcatgtttgtagaactgactttaatggtcttctacaacaattcaggctacatctgcccagagagtgtgtgtggtccacatgttctttcaaatggagaggacctaatcattaagacatagcttttttttttttttcttaactttcaggagtcagatgtggaggatatagagagaattttgacttttagtccatgttgttttccctgacacattttcaattacattgacaactaaaaaacaagaccttggcaagaacatcagggagaaatggtgatgagatgaaaagatgctcagataggcagattttgatatatgactggtcaacagaccttgggaggctctctctacaatgagaacagaagcatccttgtgctaaaggctcatctgcttacaacggttgagataaagaggaatttctcgagctagtggaagaaacaggatgagaagtgtgaaaggaaattaaattttgggattcaaaactcatttagccaaagggaaaagtcaagctgtgaactggatcatgcaaacctgcctccacctttcagttcctaaataaaatggctacaagatgcaaagctactcacctttcccatattttgccaacaaggaaattcctgatgagctgttaaaacttcaccatggcaatgctaattgatagcttatctttataggtgcagtcactcagcctgccagacacaaatgcatatcagattgttcccctaccccattttatttgtgtaatgtaaaatgcagatttcccacatttttcctttgccccttttaagtgaaaactgtgtgcttctcaatatcctgccctttcccctttaaatttggagccctcaaaatcatcttaagagaaaggcatagacctgactcctgggcgtgtccttaactttggcaaataaatctccaaaaatgattaagacttgtcttgtcattttcttcgattcacagaaggcaggatatacaagtagaaagcagaaggcaggatgtacaagacatcactctaaaacctttgaatcaacaaatgaatagcagaaaagcagatgccttgacattgtccttttaaatacacggactcaacaaatatcattgccagctcctaatatgttaggccttgctgatacattggttgactagaaagagtttcctgtcccaatggagctgatattgcagaaaaaagtaaattgtacaattaattacaaatgtgttgaatgctttgaagaagtatagatcattttgagagcctccataatggaaaatttaacctagcttagtcaaacaacacagaaaaaggcatttaatctaaggcttcaagcatgggtagacttcagcttttcaatgtgggcaaaccgatatagagaattcaggcagtgacaaaaaaaaaaaaaaagtagccttaatgtctcactcacaaagctaaatttatggttgaaaatgttaatctatcttctctcatccagaaccaaataaggattgaaaatgtatattttcagaaggattatgttaatgaatatttattgcatgctcttcctgtgccaccaaaacgctaaactctttatattcaacacattatttaatccaagcagtagcctatgtggaatgtgctatcattccttccattttacacatgaggaaactaaacatcaaagcatttacactgtatatatatgataaatccaggaattcaaataaaggtctccctagcacacataccaaactccttccacaatgcttttccacatttattagaagaaaacaggaacaaaaaaagcagtactcaataaaagcaaaataagttaccctggtgaaaaggaatgctgggaggaatgcttttggctatttataatcatacctacatcctcaaaaatccattgccagagtctatttccctgtttaacaatttgtgaggatccttagagaatcaacagcaggaggcaccactgttcagcccattagatatgatccaagatttgtctcagtgcctgactcttctgttctctagtaaggggtctatcaaaacccaatgtacttcatttttagcagaaaggacacatttcccaggggaaattgaaggtgatccttctcaaagtacaaatctagctgttttttgagatgcgatatatcgatgtctggatgaccatattgtgcaagacaattctcttcaggcccaaagttcttttcatatttacaataaaggaatgctatacagaaaaattttcacaaagatcaaaacaattcaaatagattatgccacacaatttcagtgaaaagaaagcttcaacatttacccaaagcatcatcagaaaaccacacttgctagaagacttaatgtctctcatatcacccacagagacatgagtgagtgatcattcccagaacgtgctattcaaagaaaatccattcatcttgttactagttgtcaacttcatgttttaaatctcatttcaatcacacaagaataagacattttctacacctcttagtcaatgaaagagaaatcaatacatgctttttaaaccaaaaatttatatcttcattactgagagaagtcaaaaacagaattatcttaacagtaatagtggtatataacacctctcctttttatttgtttgtgattcttttgttttcttacatagcatataaacagcttagtttatttttccttctactaagtcttcataatcatctcccttagactgagttccaaactctttggaaactactgatgcgttaattggctttttaaattatcttaaaaatataaactttattaattaccacatatgttctttcttttaaatattaatgacttggccaggtgccgtggctcacacctgtaatcccagcaatttgggaggccgaagggggtggatcacgaggtcaggaggtcgagatcagtcaagccaacatagttaaacccatctgtactaaaaatacaaaaaattagccggttatggtggtatacacctgtaatcccagctatttgggaggctgaggcaggaggatcgcatgaacctgggaagcagaggttgcagtgagcagagatcacgccattgcactccagcctgggtgacagtgtgagactctgtctcaaaaaaaaaaaaaaaaaaaaaaaaaatatatatatatatatatgtgactcttcatcaagtagtttctatgaataaaatcagatttcacaaactctgtaaagtgggagaatgaaaatctagtaggttttacttatctgccacaactaaaaattagtatagatttgaggaaatgtcattttgttttgaagagtgtgatttaaaaaaaaatatatatatataatatatatatatataatcttaatttgctttgtcactcatataaaggaaaccgtagttgagttgtagacaatgaggaaacacttgaggcttccgctgtatgtttctttgttattgttatgttgttacccagtaacttgaatattgtttaaagtgttgtaagacattgtagagtttatctcaagctgttaaaaatggtaatgtacaaatgtgaatagacacttatctatataatatgggtaagttttgttttgcctataatagatgtttataaaacaagtgagggagcagttggtatttttatttccttttctttctttctttttattgaaaaatcaagattgtataaaccaaaagctgcaagatgccaaaatcttgtagatgtcaaataaaaagttattttactaaaaaaaaagtgtgcgttggtaatcactactattaataattttaaaaaggataaataaggtcatataaccctgtctctggttcagcaatttggaaaagttgtagttagaacaggagactgttctaatagagagagtgaagagtacaatatgtagtttagttctctcatttggtaggtgcagacacagaaggaatgaaaggctgcatttacacgattagctagatctgtacaaacatttagtactttaacttttctcaaagccttttatgtattatcctatgggtaatgttatcccaaatgtatggataaaattaaaacaagaacactaaatgacttcacaaagacctgaaaggcagatcaacggcataactaatattaaaactcaggactagtgctctgaacatcaaacctcctggatgaggtcttccgtggcacatctctcatttgttgaacagtttttaaaatactgtgtgctgggctttaggttgagagataggacacgtgatttatcccttcagggtgtttgcatcataaagaggcctgtgatcttcaattaatcatgtggccaaagttatttctaggggtcagggagtcattgacaattcattatgccaaatgtgccaaaatgccgaaaaaaaaaaaaccaaaaaccaataatgtaagtctcctgaatataaaattttcaaaaactgaattagaaacatttttttttactctagcaagagcaattcaataaaagcagacatataaaggataattttttaaatctgtgaccaaaattgaatatgagattgattcatctacaaagtgtcttacttttctgtagtacaataaaataaattatactgtcctagacaggcaaacttcaatataagggagatttaatgtcgtctgtcctatcatagtgaaatttgactccactattagtttctgaatactttcatgatttccctcctgctagtttaccatgagacaccatctcagacttctacacagctcatttgcacccatcacaatatataaataaacaggagtgtgccttttctctgccgtatttccactcaactaattcctgtatctttcagctccaccagttctttgtatacttgcaaataatggctgaaaatatttatattttttcttgacttcatatttcttctacacactattagttttcttactctgtaatttaagtgacagatttggagtgggacaaatctgtatgaaaacttataaattaaatttcccatttaatgagaagattttaagtagaggttaattggtaaattactttctcccttttcccccatgctcttttcatattctgattgcattatatgtatgtatatttctagttatgtgtacaactatacaaaatttgggaatataaattcatttcattaacacctgtaccctttttgctcctactcaactcttttttgcacgcaattcagcaaaacttttggaaatagttgtccatattcactggcttctctttctcattttttcacctctcacacaatcctttggaataaggttttcatcttcataattccacagaaacggggaacactcatgttgccaaattcaatagctacctctctaacctcttcttattccatctcttagcacacaacacagttgaccagttgctcatgccctgtttctttaaaaactcctttttcttggcttttttgaaccacacttgtctgtgacagccaccactccttgacagctgtgctgtctccatttgacctctaaatgttaggactgatttgtgttaatagaattataggttacggagatggagccctcacaaattggattagtgtccttataagggccaaggaaaccagagctcttcccctcaactatgtgaggacagagtgagaaggttccttctgagtcatatagtgggtgttcaccagataccagttttgctggtgacttgatcttggacttctcagtacccagaactgtgggaaaaaaaatttggctgtttataaactactccacttatgctattttgttataattgctcagagtaagaaatgaagatatttcatcttacttatcttattattgctatttctccagctttggacacaatacttagcactttgtggaaactcagtatattttttaaatgaataaatacataaatgaattcaccaaataggtagttaaagaaccataaaaatcatcatatccttgttttcgaagtgaattagaaccagctgagttgcacagaattgtaaatcagaacatcttgctgatctttatctctgcatacagacctgattttcatagaactcactgtctgaattacatgtgacaacagatacaaggatgtagatttcactttattttgcaaacatgaatttcatcatctacatagtggatagttgattctccagtgaagtcagatttctgaagtgttaatttaatattgtgctattatactttaaaaaaaaaaacatagcacacatcttctagtaaaatggcacatatctttttgcaatagtcaggaactacagacatgagctaaatcatgtatttgaaaggtagtcccagagtggctaagtcagaataaggtatatctttctttctaaagtactgctttgattatattattttctgctcctcaatccacagtagcacctattagcagttctgcctttggcaattgacatatgttatctcctgttgctatttatcaatttactgtcagttatgttctctctctccaattggactgtaggtttttggcaagatgcaatctggaagtaagctctatcaaaagtagttattgaatagatatttgtaaaagattacgatgaaaacatttctaactctccaaatctaactccaccttatctttagtcttaaacacaacgtgaaaattaaactaaaaacattgaacaaattaatcttgacactgtaatatattgcaatggctaaaataattttgaatcctaaatattaattttgttatacatcttttttatatatatttccctgtatggaacatgttatgaataaatacttgatgttctttacacagtctagagcttgctacatattgttgatcatctcagaaacagcttaataaaatcagcatttgaaaatcccagtatcagcacctgtgacattaataattctggtgaaacaggtgcttcctgggaatttcaaacatttgaaaataaagtgataggccggacgcggtggctcacgcctgtaatcccagcactttgggaggctgaggcagatggatcacgacgtcaggagatcgagaccatcctggctaacacggtgaaaccccatctctactaaacaaaaccaaaaaaattagccgggcgtggtggtggacgcctatagtcccagctacttgggaggctgaggcaggagaacggcgtgaacctgggaggcggagcttgcaatgagcctagatcgcgccactgcactccagcctgggcgacagagcaagactccatctcaaaaaaagaaaataaagtgatacttcgagggaattagttgtgtcacagataaaaatagattgtgcttcactgcactcattttaaaacatagtgactgtcttcaatgctactttacaagtgaggaccagataattaactgaagtttctttctcaagcctgattgcgttgtttctttttcttcactactcttctcctttactgtcccttcaccatttaggaggaggatatgcttttctacacatctgttccttaggaggatggttgatacagctaccaaaaaaatttgtttcatgttttaaagtaatcatcattctcagtaaactatcccaaggacaaaaaaccaaacaccgcatgttctcactcatagatgggaattgaacagtgagaacacatggacacaggaaggggaacatcacactctggggactgttgtggggtggtgggaggggggagggatagcattaggagatatacctaatgctaaatggcgagttaatgggtgcagcacaccagcatggcagatgtatacatatgtaactaacctgcacattgtgcacatgtaccctaaaacttaaagtataataataataaaaaatatgctttgcagagttaaagcaaagaaaaagtcgtaaaagacaaactatattttgtctgtgagagccagcttgttaagacagaaaagttgtttcttttttacatttctaaaacttggttttaaatgtgaagagacaaatactaaaagcaacagaacttaaggtttctctgtaaacaaatgtgtttgtttcagtcataccagatattatgacaaacaaatgctaagtttatgagatttaaaaccatgaaagtatatttttgaatgcattaaaataccgtgaaggtgttaatggttcgtaactgggagtggcacaaaggccagttctgcctcctgaaatcattgacagacactgagctgatggaagatttgtttttttaaatatatctcttttaagatcatcgtgggtgttaacaggtagccaagaatgtaagaaggagaatattaaggttgtacatttgcttaactgccttggtctaggaaaaaaaaaatatcttccatgtactttttagcctgaagaagttacttgaccccagtcagataaaaagaaagctgacaaataaccatatcccaggaataactctgttttctacaagaggactaaaacaggaagccaagggaatgagtctgtggttatcattttctaaaaagtgggctctgtcccctgtcaatttctgaagttgaaattttagaggtagagagaaacagaaaccaacacataggtatgggactcagagaccagagagtgtttgtgctcaacttgctttatggaactcagaagagatataatctcatggagaattcactgctcacacaggctagcatcagcagaattgtaatggtggcaaaacagtatagtccgatatatagattgaaataggacccatcctcagtctatcagaggtccttaacgatgcaggagatcatctgaaaatagcttgtcctgtcccatattgattcaagataggccagagagaccttttagttgcaaaggatagacagagtaaatagcaagtacctaatgactggagaacagggtagcagcatagacatggatatcaagcttaagtagggataagtgttgacaacctacggtatgctggcattggtggggtgaggttttcttctccttagaaaagaattcagttaaatagaggtatagaagaataaatagaagtatttaatgatatggcttagcttggtggtttgaaatacatgcctgctacatctggattctgaatatttctgtatttgtaaccatctcaaaaactccagggtattaataaatttgtccataaatacttaacaattggaaaggcatatggctttagatttaccttttcatttcaggattttactcattaaatcagtattagatgctgcagcataattaagttgaagctgacatttgagaacattatttgtttttctctttcatgacatctaaatacatttgatattttttcccaattgccaatcaagtattcttccactagaatttacttttacctgattttaaaagaacattccaatcatggttggtagccatatggacctctcactcaactacaatgtcagtggctctgggagctatttgtctgtgtctgagtgataaaatctttctcagttccctttgagataattttcctctcattttctactgccaaatggacaatctttggatttctccctgaagtggtctttattctcaagtgaccttcaaatggtttacctctgagatattcccacagcacacccaaagtgaagatatagccccttcaaagttggcaacaatacatctagaagttttctcatggtggtaaaatagacaataatttcattttttctaaatagactcactcaagtcaatatccacacagcttcccacacacaataacccattccttttgtatacccttggtgccttagtctaggtcttttttctgaccatagcatccttcattatcttttcagatctcacttctttcaacatcaagccttcttatgtccagtgataagatttatgtctttttgtaagaattttatgtatttattaaaaacatcatttaattgacttaatcagtttcattgggattacttttaaatctttattaaagatccttcagagcaagggccattttatacatcttttttggtaatttttctatattgttacctaagttcacattatcatagagattaatcagaccacacaaaacagtgaaattgatagtgactatagagttagcctgagtgttcagtacaggatgactggctccttttgaataataaagatgatctctaaaataatagcatatatctcattaatacaattatgatatcttgaactgtgcaggacaaacagtcctatttttattatatgaaatagtctttgtaagtatctaattacctacttcccttgataacactgaaaaaagaccttgaatcttaaaaatttccactttaaagtaagtatagtgcaaggacagatcaatgtagtactatgtttttatgccctctctgcagcgagtttatatataacctgaacttttcatagctcccaaatccaaaaaaaaatgcttgcaaccataatttactttttacatttaaactatcgacaataacttcatagcactggtccagttgctcatttcacttgtgaaaggggtcaaattttcacctagagttttattgaatgccacattttatagtaactgttactcaggcttattgtttctcacagttgtttgtttatttttgtgtgtgtgttgttttctcctatgtttatcatcacggttgcttcctgaggaacttttgctagtcgtcgcttcaaagtaatatctccttttcaagaatgggtaacttgataacaatgaaacaatcaaggtattgactcagaaagacttaaccaatgtaaacacacttctctttactgatattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtctcttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgttgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctataaacatatgtgtgcaagggtccttttcatataatgacttgttttcattgggatatatacccagtattgggattgctggattgaatggtagatgtacttttagctctttaaggaattttgatactgtcctacatacaggttgtactaagttccattcccatcagcagtgcaagctgctttttccctacatccaccccaacatatattgtttttcgacttttcaataacggctattcttgcaggagtaaggtgctcattgtggttttaatttgcatttccctgaagattagtgatgttaagcatttattcatatgtttgattgctgtttgtgtatcttcttttgcaaaatttctattcatgttctttgcttactttttaatggaattatttggggttttttccttggtgatttgttggatttccttatcgattatggatactagtcctctgttggatacatagcttgcaaatattttctcccattctgttgatcatctgtttactatgttatttcttttgccgtgcagaagctttttggtttaattaagtctcatttatttattttggtttttgttgcatttgcttttgtggtcttagttataaattctttgcctaggccagtgtctagaagagtttttgtaacactgttttctagaatctttgtggtttcaggtcttaagtttttgatccattttgagcttacttttgtatatggtgagagttaggaattcagtttcattcttctacacgtggcttgtcagttttcccagcaccatttattaaataaggtattccttcaccaacttgtgtttttgtatgctttgacatatcacttggctgtacatatttggctttatttctgggttctctgttctgtgccacgagcctatgtacctacatttataccattgccatgttgttttggtaactgtacccgtgtggtacaatttggagtccagtaatgcgatgtctctaagtttgttcatttgcttaggattgctttggctatccagcctctttttaggttctaaattaattttaggcttgctttatttttctaattctttgaaaaatgctgttaggtgtttgatgggaattgcactgaatctgtagattgctttggcctgcatggtcattatcacgatattgattcttccaatgaataaacatgggatgcatttccatttctttgtgtcagctatgatttctttccagagtgttttgtagttctccttgtagtgatctttcacttccttggttaaggtatattcctggatttcttttttatttatttattttttattattgacagctgttttaaaagggattgaattcttgcttttattctcagcttggtcatttttggtgtgctactgatttgtgtacattgattttgtaatctgagactactcaattcatttatcaaacctaagtgtctttggaggagtcttaggattttctaggtattcaatcatattatcggcaaacaacgataacttgacttcctcttttccaatttggatggcctttatttctttctcttgactcattgctctggctagtatttatagaactatgtagaataagagtggtgaacgtggtcatccttgtcttgttcctgttctcagggggaatgctttcaacttttcctcattcagtatgatattggctgtgggtttttcatctatagcttttattattttgaagtagttttcttctatgcctagtttattcagagtttttatcataaaggggtgctggattttgttgaatgatttttctgaatctattgagatggtcatgtagttttgtttttaattgtgtttatgtgatgtttttaattctgttttctgtgacgtattctctctcgatgaatctagctaatagtctatcagttttattttttcaaacaatgagttttgcgtttcattgattttcatatatttttgtgtttgaattttattgagttctgctctgatctttgttatttcttttcttcttctagctttaggtttattttgttcttgtttcttctgttccttgaggtacgacattagatcgtcaactgtgcttttttagactttttgatgtaggcatttagtgctataaagttccatcttagcactgcttttgctgtactcgaggttttgataagttattgcactattattcaattcaaagaatttttaaagttttgtcttgactttattgttaaccagataccattcagaagaagattatttaatttccatgtctttgtatagttttgagggttctgaaactgcctttgcaaaattataactgaggaaattatgacagtgcagtgaaataaatcagaacttactaactctatcttgcttctaacccttaagctgtccttgttcattcctgggtgtaggctggactaactttgggaaggaatttagttcatggtttgactctgaaacaaaactgataacaaccctttcttgcctggtgtccagtctgctttttcaggactaataaattagctacaagattaaaaattataatttaggggtcatacagcctctggctccaagagtctgaaaatccacaaattgctcctagggataacaccactattgtaaaacctaagatcagtgcttgagatattttgcagaccctgaactccatagatcagccaacaccacccagaccagtaatctggcccaaccagttctgccaatgcacccaagtacagaagacattaagaaaacctaactttgacctcctatggttccatctccaacttgaccaatcagcacttcccatttcccaagcccctacccaccaatttatctttaaaaagtctgattcctgaattctcggggagactgatttgagtaataataaaactccagtctcccgcatggccagctctgcatgaattattttttcaccactgcaattctcttttcttgataaatcagctctgtctaggcagcaggcaatgtgaaccaattgggctgttacagttctttgtgaagttgatttctagttttattctgctgtggtctgagaagatatttgatataatttccattttaaaaaatttattgaggcccgttttgtgacctattatatgatcagccttggagaatgttccatgtgaagatgagatgaatgtgtattctacagatcttaaggtaaaatgttctataaatacctggtaagcccattagttctagtgtatcctttacatttattgtttctctgttgactttctgtctcaaagatttgtctagtgctgtcagtggtatatagaagtctctcaccattactgtattgctatctcattacttagatgtagtagtaattgttttatgaatctaggagctccagtgtttggtgcatacatatttaggattataatatctacttattgaatttatccttttatcacatatgtagtaatgatctttgtctttttttaaatttttgctgctttgaaatctgtttggtcttaatatgagtatagctgctcctgctcacttttggtttccatttgcatggaataccttttcctacccttttactttgagtttatataaatccttccctgttaggtgagtctcttgaaggcagcagatatttggattgtgattttttaaatccattctgccattctgtatcttttaaatggagcatttaggtaacttacattcaacgttaatattgaaatgtgaagtactgttctcctcatcgtgttaattgttacacagatagtttcttttcattgcattattgttttataggccctgtgagttttaagcttttaagacattctattttgctgcatattgggtttttgttttaaggtttagaacttcttttagtatttcctttagtgctggtttggtagtgacaaattccctcagcatttgtctgaaaatgactttatttctcatttatgaaactaagttttatgggaaacaaaattcttggctgacagttgttctgtttaagaaggttgaaattaggaccccaatcccttctggcttgtaaggtttccgtggagaagtctgttcttagtctgataggttttcctttatggtttacttgatgcttttccttactgttcttagaattctttctgttgactttagatagcctgatgactatatgtcttgctgaagatctttttgcaataaatttcccaggagtcttttgagcttcttggatttggatatctagatctctagccagaccaggaagttttcctcaactattccctcaaatatgttttccagatttattattttcacttctccctcaggagaaggaaagccaattattgttattcattttatgtatttccatatttcttagagactttgttcatttttattcttttttatttttgtctgattcagttaattcaaaagccttgcctttgagctccgaaaattctttctcctagttgttctagcctattgttaaacatttccacggcattttataattattgcccaagtgtatcttttattttcagagtttctgattaatttttctttacgatatcactctagaaaatttttcattcatatcctcaactgccttctaaatttctttatgattttttttttgcctttctctgatatctccttgagtagcttaataatcaaccttctgaatttatctggtatttcaaaaatttcatcttggttgggtccactgctggagaactagtgtgatcttttgcgggtgttatagcaccatgttttgtcatattaccagagttatttttctggtccttctcatttgggtagactattttttctaattattctttattttacatttgatttaattgtgtttcctttgtttgtttgcttttaatttttttcctctttaaggatgagacttcaatgctttgagttaattgtagcctaatttggttcttggtgctttcagggtcaaagactctgaagagtcccttggttatagaaagtgtttgtatgatggctttctcatatgctggtatagtagcaatgggctcagtgtggaaacaaattcagtatctcctatggggttggaatggtagaggtctcttaaagcttatctcattcccctgtggtggcactttatttatttatttatttccccccatattttatttactggtttgatggttcagatttcaggccagtaggggaggtatccctgggtagggaccagttgtaggtaaagcaggtggataaataaagtcccagcattgacagaggtaagtggaggagcttaagtgagttgcactgaggttttatcaagtgaagttttggaaccactttagctccctgccaggtcagtaggaaagttatccacctctcagacatgctactatcccagtgttctggttattcagatcaggcaggcacccttttcatctgtagaaatgttgaccttccaagtagagaggaattgtgactctgtctctcatgcaagcctgaacccaggtagtgctccttctgtggggatgcagtaccctgatgtgttccagaaatgctgtctatggttgcacccatactgagctcctgttggagaaacccaaactgcgcctatgatggtggataaggggggaaaggcttcctcttctccagtactcttcatggataccaggactgtctgactgttggaactgtctgactgagagctgaagaccttccctgcctagccccgcacctcaacagtactgctgctgaaggaagctttccaccagtggaaggatcctgtggtcaaggcctgccatctggattcttttgtcttacagtgtgttctcttggggttggaatggtagaggtctcttaaagcttatctcaatcccctgcggtggcactttatttatttatttatttccccccatgttttatttactggtttgatggttcagatttcaggccagtaggggaggtatccctgggtagggaccagttgtgggtaaagcactctcccttcccctaggagtgggaatccctgggagccagactactgtgggtgttgttgctcctctgggtctagctgctcagtggaattgccccactccaggctggtgttggggaaatgtttgcaagggatccactgatgtgacctgtcctcaagttttctagcagtgggtaatggcaccagctctaatgggagtggcaaaggagtgacatagattctgtgaagttccttggttattgatagtcttagtgtgttggctttcttgaacactggttatagcagtgatgaactggtcacatggacagattcaggagcccctggttagccagagcggtgtaggcaatggtgatagctgagatgcacagccttctccttcttggacacggtgttattctaccaagaaatacagtaatggactgtgtcggttgtcctgcagccaggaggtggtgcttgccaaaaagcatcagctgtggtggcaaccgtggcagttttgcttgccttatgtttcctgttggaggggagtatctctgatttctcaggcaatgggcagggccaagtagctcccaagagattttgatctttttgttgagctaccagggccgatggcagggcaaagccaggtgggagctgggttgggcaggtttgcattctgagtctctgtgtgtagggcaaacagcagcccctgtgggtttttggggacaggggcaggtttcaaaccgctgggttgatgttccagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttggtaaggcggtaatcagcactcaccactaacagtagtcataagattttcccacagagaaagcaaccatggcttttaggccttgcccttctctgtctgctgcaaagccaggcacctggcatctgcacccagggctcctgcacccatgggcctacactcatgactcttgcactcatggcacgcttttcactctccccatcctggccctggccaagggagttcgtgtccacccaaagttatattattaaatccctttgggagcctctttctacctgtggccaccacttgaaatgtttggctctcttcctcagcaccctttgtgaggaacagtaaagaatagctaccctcagttcacactgggatctaggagtccatgcaagggtcttcccactgctgatcctacttttatactccatgaccctccccaactctgtttctgcacagggtggggttagggccttcccccgtgtattgagctttcagggtccccagtgggagtgtatatcctagaggcaaactctccccttctcatactctatgtactcacagcctttgcctgactcacactgtaggctgcagcctctagcatccttcaaagtgtccataaattcctccggttttcctgttcagttcctgtgtcacttcttgaaaaaaattcacagtgtgaatctctgcacactattttgtccttccaagtgtgagagatatgctagcaatgccttcaatccaccatcttggggggaaaaaactctaatttgcttttaaattagattttgtattaagacttttaataatcaaaataatcactgaatgctgaactgaatttttaaaatattaaaaatagcaatagttcagtctgttaatcactaacctaacatacacatttattaaaaccctatttccaaagttgaactgtaattaagtttgtatggagagattcacataaaagttaccccattacttctttagtagtttttttgttgttgttgtttgtttttgtttttgagatggagtcttgctctgttgcccaggctggagtgcagtggcaccaacttggctcattgcaacttctgccttgctggttaagtgattctcatgcctctgcctcccaagtggctgggattacaggtgcccaccactacacctggctaatttttgtatttttagtagagatggggtttcaccatgttggccaggctggtctcaaactcctggcctcaagtgatccacccgcctcggcctcccagagtgctgggattacaggcgtgagcgaccactcctagaccctttagtagttttatagtttgggctcttatgtttaagtctttaattaattaagatttttttaatatggtgagagatagggaatctagtgtcattcttctggatatgaacatctgttttcttcctggaccatttatcaaagatggtatctttcctcaatgtatgtttttggagcatttgttgaaaatgttccaatagtcacaaataaacattctattaaaaaattttttgaataatggttagcatctacattacagttaatagctaggtcttactgttaataattgactaatgaactgttatactaatattcactttcaaaaccatcataaaaaaacagttttatgaaatagatacttttagaattaatggttaatgaaaacattcatttttttctataaagttatttttgtgtaatattttttcttttttattgatacgtaataatagtacatatttaagaggtgcatgtgtgattttactacaagcatacaatgtataatgatgatcaattaaggtaattaggatattcatcacctcaaacatttatctttttgagtgttgagagcatttcaaatctttacttccagctattttgatatatacaataaactattgcttatgtccccatccctaccctcatttatgcactttttccagcctctggtacctatcgttttaccctccctacatgagataaactttttaacacccacatatgagtgacaacatgcaatatttgtctttttgtgcctggcttattttacttaacatagtccatcagttccatccatgatggtacaaatgacagagtattatatttttatggctgaaaagccttttatttataaagtttttatctgttaatctgttcacaaacacttgtattggttctatatcctggttattgtgaacagtgctgcaataaacatgggaatgcaggtatctacttaatatactgatttcctttcctctagataaatacccagcagtggcattgtggggtcatatggtagttctatttttagatttttaaaaatgaacctccagactgtttttctataatagctgtactaatatatatttccaccaacagtatataattctcttttctccatattcttgctatcatttgtgtgtgtgtgtgtgtgtgtgtgtgtgtgtgtgtgtattttgataatagccatgctaattgggtcgagataatatcttactgtgattttgatttacatttccctgatgattagtgatgttggcatgttttccatattcctattgaaaacttgtatgtctacacttgagaaatatatattaatattatttgcccagtttttagggagattatttgattattctgttgttgcattgagttcctcatatattctgcatattagtcccgatggatgaatagttcacaaatattttttccagttctacaggttgtacctttactatgttgaacatttcttttactgtgtagaagctttatagtttaatatagtcccatttgtctatttttttgttttgttgtatgttttgaagtcttagtcataaaatatttgcattgactaatgttttgaagaatttctcctatgttcttgtttagtagttttatggtttggggttatatttaagtctttcatcaattaagtttttttaatatgatgcaagatagggaatctagtgtcattcttctgcatacggatacctgttttctccaggaatatttatcaaaaatggtgtctttcctcaatatatgtttttgaaacatttgttgaaaattggttggctgtaaatacaataatctatttccaggttttttattctgccctgttggttaacgtgtctgcttttgtgccaatatattgctgttttggttaccatagcttagaagtatatcttgaactcaggtagtgtgatacctccagctttgtcttttttgcttaggattgctttggctatttgaggtttttacggttacaatttttcttttaatttctgtaaagactatcatttgtattattttttttgagacagactctacctctgttgcccaggctggagtacagtggcacaatcttggctcactgcaacctccacccttcaggttcaagcaattctgctgcctcagcctctcaagtagctgggattacaggttcacatcaccatatctcgctaaattttttgtatttctagtagagacagggtttcaccatgttggccaggctggtcttgaactcctgacctcaggttaactgcccacctcagcctccaaaagtgctgggattacaggcatgagccaccatgcccagattgtattttgataggaattgcattcaatctgcagattgctttcaatagtatggtcattttaacaatatcaattttttcaatcgttgagcatggaatatttttccatttgttttcatcctcttcaatttattttatcagtgctttgtagttttcctaatagagcaattttcatctacttgtttaaatttattcctagttatttttatagctcttgtaaatgatattgttttcttatattcttttttttatctagtttgttattggtgtatagaaatgctactgttttatatgttgattttgtattctgcaagtttactgaatttgcttatcacggctaagaggtttttggtggaatctttaggattttctatataaagactgtgttatctgcaaaaagagacaatttgtcttcctcttagattggagtgtgttttctcttctttttcttgactaattgctctggatatgatatcaagttctatgttgaataagagaggtgacagtgggtatccttgtcttgttccagcaggtttccaccttttctcaatttcaccttttctcaattcagtataatgttagatgtggtttgtcatatgtggtctctattatgttgaaatatgttccttctatgcctaattagttgacagtttttatcatgaaaggatgttcaattttatcaaatgttttcctgaatctattgagatgatcatataatttgtgttcttctttttttttcttttttttgagagggagtctcactctgtcacccagactggagtgcagtggcacaatctcggctcactgcaacctccacctcccaggttcaagagattctcctgcctcagcctcctgaatagctgggacaccaggtgtgcacccccatgcttggctgatttttgtatttttagtagagatggggttttaacatgttggccaggctggtcttgaactcctgacctcatgatccactgcctcggcctcctgaagtgctggaatttcaggcatgagccaccacaccgggctgatttgtgttcttctttctgttaatgtgatttatcaattctattgattagtatatgttagatcatttttacatccctgagataaatcctacataatcacagtgtaccacctttttcatgtattattggattcagtttgagtactttattgataatttttgcatctatatacatcagagatattagcctgtaattttcttttttgttgaattcttgtctggttttgtaatcaggtttagctggccctatacaatgacataggaagaattccctcctcttcagtttttttaaatagtctgagaagaatagatgttagttcttctgtataggtttggtagaattcagcagtaaagccattcagttctgagcatttctgagttgggaggtttttttcagctattattgcttttgattctatctctcttatagctcaaataatatctgtttttcctatcagggtgctgtggtgttggtgaatataccttcacaaatgttatatactcttgaaaattgattcctttattattatataatgatgtcctttgtctttttttatgtttttgacttaaagtttattttgtgtgatgtaagtgaagctactcctgcacagtttttgtttccctttgtgtggaatattcttttctgttccctcactttcaatctatgtgtgtcttcacaggtaaagcaagtttcttgtcaacagcatatagttgggttttgtattttttatccattcagccagtacatactttttaagtaaggaatttaaaccttttacgttctggaatgttattgataggtgacaacttactcctgtcattttgtcaattattttctaatgttattgtatattgtttctttcattctcttattttttacatttacaatttgattatttttgtagcaacaacatttgatagctttctctttctcattcgtgtatatactctaccagtgaacttagtacttttgtgtcttttcatgagggtagatatcttttcactcccagattttgcattttcttaagcatttcttaagcatcgtaggatcaacctattggtgacaaattcccttggtttttcttgcctgagaaaggctttatctctccatcattttggaagaatagctttgcacagtttattattctttactgccatgttttgttctgttttgttttgttttgttttgtattgttagtactttgaatatcccattctttcctggcttataaggtttctgctgaaaaattttgagaaattagctgttgatctgatggggatttccttatatttgatgatgttttttcttgctattttgatggttttactctaccttaaacatgaccttttagaattgaatctacttgggaatatttgttgcatttcctgtatctgggtgaattcatgtatatggatgcttcttataaatggatgcttcttataaatggatgtatatattttgttcaagacttgagaaattttaacctatcattttgttacataagttttccatctctttttctccacaattcccaaaatttgaatatttggttactttatggtgtcccatatgtcacataagctttcttcattctttttaagtccttttttcttcttttgtctatgacatttcaaaagacctgtcttcaagtcagaaattctttattctgcttgatgaagtctattgctgaagattttgattgtatttttatatcactgattgaattcttcacttcaggatttctgtttgtcttttttatcatatctagcaatttatcattcagattataaattattttctaatttcccaattgtttatctgtgttatcttgtatctggctgagttcttcaatattattattttgaattcctttttagatattttatagatttttcttttttgtgatttcctactagagaattattattttccttcggtggcattatgtttccttgctttttcatgtttcttgcatctttaaattgacatatcagcacatcctgggtgacagtcacttacttcagttacatggattggcttttacgtggaaacactttttttcaattgctgagcagttctgctttttaaagcagcaactgagctgtaaagcagacccatccttagacaggaaactgaatctacgtgggaggaagacacagtggtgggcaatctggaagctagaaggaaggacagtcagagtgagtattgtaaagccagaagcatggcttatctaacaccccgctgggatatctaagagagcccccttctcaggtttttttctgtctcaaaagaaactgaggcatgggtagtgataaaatcacaagtaatctcaccctaccaaaacccagtctcctcattaaatgctacagaagtctggaaggagttctcattatacaggcctatgacactctcactgtccaacagtcttcatttctggttttgttcaagattatatccctctcacacacaaagaaagcatttatcatgagagaattttggtactttatgaagttgtctgcctttaattatttatattgtcttctttctcttagtatttttgttttttttttctttagggaagggatagaggggactgtttttgatattgctattcttcttctgtcatctaggtaaagcttcctttgaaaatgccaacctgtttgaacactcctcaggagacatgatgaaagatgttctctataatttatctgtatattcccagtttccaaatatggcaataacagcaagaataaacagacggatatctcaataagatgaaaaattagcaggaactgatgaagggacactcttatcgctgttgctttccattatgattgttgaactcaaacagctcttcctgtgtctcaggcagaatcaattatagatagaaaattaacttacaaatatctttatttacttgattaggaaaaggatactgagtagtcagcaagtaatagttaaaaagaaatcataaaattggaatcacaagatctgtgttccagggcttcctttgactttaaaaagtggattacccttaactgagtcacatacttctttaagatttttttatatcatcatctgtacaacaggaacagcaaactagaagatctctgagatccccttaaattttaaattgtttcaaattataccctaagatatctgagcaagaaagatttaaagagcaaaattttacctcaacagagatgagagtttgttagtgtaattgagggggtcaaaacaaaataatatattgttaaatagtgggtgaagacttagagtgatagaagtcttttccataaaaaaatttagtttttaataaatcctttcactgacatcaacacagtaataaaggagaagcacctataacacggcttcaatagcaatttttacagcaatgtgtaaaacatgccatcagagaagaattcctgttccttaaatttccacgttacccagcatctgccatagctaacaggaaatgaaatagaataaactatggaaagatattgaataaagactccttaactatggagtttgataatttgaagtaaggaaataagaattctctgcttttagaataagaaacataattccaacaaatgaaaaatctactgtttctccctgtggaatgtgaacaatctagcataggtttctgaagggaacctggcgctatggtagaaaatgatcagaactgtattgatttacatatgtttcttactcttataggcatataggagccttgcatgaccacactttaaacaaatattttcacagtatttattattgatagcatacatgcattaaattgttttttataaactctaataattaacttcataaaccgtcttaaataaatgtttttcttatttgtataatgaccttagtttaaaatgtaacctttcagatattttcagaattacgtacataaagagggtgaacctatcttagaaatacaatagtttccgctttccagaacaataagactaatgaaaaaccgctttaaataatgttgcttgagggatggtttctctctaaacaccagaatgtgtagaaaatgtttacacggcaaaataaataacctgttaagaggcttaaaattttagttagaacaataatatacacagtcaacataaaagccttgtttacatggttgtttgggaatattttaaaacaaaaacagtttgcttcatattcagatctcccatggctcccaaagaagactttagttagagaaaaagagttgtttaaataaagagaattcatttatttctgttatagtgtaataataataactagtcatttatagttattcatacatttgtataatttgaacaaaagccatcagcctgaggctttctttctcatttctgcaaataaagatatagagtgtttgaggaattcatgtagtttgcaaatatttgcttttggagacaaatgatgataattaaataaaatgctgtgtgttttgttgaatgagcaatgtaataacatttaggcatgtaaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgcattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaaagggatgaaaaagcatatttcatgccaatgtaaaccaaaaaggagcaagagttgtgatacttatatcaggcaaaatagatttcaagactaaaactgcaagagacaaagagggtcactatataatgataaagggatgaattcagcaaaaggagataccagttttaaatatatatgtaccccaacatttggagaattgagatatataaagcaaatattatagctaaagagagagatagacctcaatacaataatagctggagacttcaacaccccactttcagcattggacagatctactgaacagaaaatcaacaaggaaatatcaggcataatttgtactagagaccaaatggatctaatagatatttaaagaacatttcatccaatggttgcagaatacacatttttctcctcagcatattgattattctcaaggataggccatgtgttaggtcacaaaacaactcttaaatatttcaaaacaaattgaaataatatcaagcacattttctgaccacaaaggaataaaactagataataacaagaggaatttgaaaactacatgaatacatgaaaagtaaaaattgtgcccctgaataaccagtggatcaatgaagaaattaagagaaaaattagaagatttcttgagacaaatgataatgaaaacacaacatacgaaaacctatgggacacagcaaaagcagtactaagatgaaagctgatagctctaaatgcctacatcaaaaaagagaaaaaacttcaaatatacaatctaatgacgcatcttaaagaactagaaaagcaagagcaaatcaaacccaaaactggctgaagaaaataaataataaaaaatagagaagaaataagtgaaactgaaataaaaaatagaacaaaagtcaacaaaacaaaaagtagtctttttaaaaagttaaagtaagtggacaaatatttagccagactaatagaaaaagagagaagatgcaagtaagattagaagtgaaaatggagacattacaactggtatttcagaaatttaaaggatcattagcagctactatgagcaactacataccaacaaattggaaaatctagatacaataaatgaattcctagacacatacaatctaccaagattgaataatgaagaaatccaaaatctgaacagactagtaataaataacaagatcaaagccataacaaaaagtctcccagtaaacaaaagcccaagacctgatggcttcactgctgaattctgccaaacatgtaaagaagaaataatatcaatcctactcaaactattctagaaaataaaggaggagagaatacttccaaactcattcttcgaggccaatattcccctaatgccaaaactggacaacaacacattaataaaaaataaaacctataggtcagtatctcttataaatattgatgcaaagatcttcaacaaaatactagaaacccaaattcaacaatacattagaaagatcatccttcatgaccaagtagtatttatctctgggatgcaagtatgattcaacatatgcaagtcaatcaatgtaatacatcaatagaatgaaggataaaaagcatctgatcatttcaattagtactgaaaaaacattttataaaattcaatatccctttatgttaagaccctcaaaaaactgggaatagaaagaacatacctcaacataataaaagcaacatatgacagacacacatctagtgtcatacggaatggggaaaaactgaaatcctttcctataggatctagaacatgacaaggatgcccactgtcaccagtgttatttaacaaagtactggaagtctttgctagagtgatcaaacaagagaaagatataaaaggcatccgaattgaattgaaagaagtcaaatttttcttatttgcttaggatacagtcttacatttggaaaaacctaaggactccagaagaacactactagaactgatcaacaaattcagtagagttacaggaaacaaaaccaacatacaaaaatcagtagcatttccatatactaacagtgaaaaataaaaaaaattaaaaatagtcccattatactgaccaaaaataaaattaaatgcctacgaattaatttaaccaaagaagtaaaagatctttacaattaaaactataagacactaataaatgtaactgaagaggaaaccaaaaaatggaaaaatatttcatgttcattgattggaagaatcaatattgttaaaatgtccatactactgaaccaacatataggtttaatgctcaaaataccaatggtattcttcatagaaatagaaaatacaattagaaaatttatatggaaccacaaaagacccactaccctaagcaaatagaacaaaactgagggaatcacattacctgacttcaaaaattttgctacacaactatagtaacaaaaatagcatggtactggcataaaaagagacacatagaccaaaggatgaatgttgagagcccagaaataaatctacacaccaacggtgaactcattttcaataaaggtaccaagaacatacactggagggaagacagtctcttcaataaatggtgctgggaaaactggatatctatatgcagaagaatgaaactagatccttccctctcaacatataaattaactcaaaatggattaaggacttaaatctaaggccccaaactatgacattggaaaaatcttcagaacattggtctgggcaatttgtagtgcactgggagtgtcataataccttgttttttcatatttcctgtattattatgctgattttttgcatctggagaaatagttgcttctatttatttttgaatttattttgttggggtggggctttttccccctgagaatacaacaatgatgtattttgaatagggccgtatggctttgcttctgagtacattcattgttaaagactgcttaagttttttggttataaatagccttaatatagtggcttcctcaaatgctggtagtagtagcaagagagcttgtgcacagcaaccaaaataacagagtaaacaacaacctacagagtggaaaaaagtatttacaaactatgcacatgacagaagactaatatccaaaatttacaaggaactcaaacaactcaacagcaataacaaaataatcccattataaagtgagcaagtgacatgaatagacatttttcaaaagaagacatacaaatggccaacaagcatataaacaaacattcaacatcatttctcttatcattagagatacgcaaatttaaaccacaatgagatataattttaccctagtcagaaagactattattaaaaagtaaaaaaataatagatgtttgtgaggatgtgaaggcaaaagaatgcttagtaaattaatacaacctgtttggagaacagaatggagatttctcaaagaactaaaaatagaagtaccatttgatccggcaatcccactactgggtatctacccaaaggaaaagaaaatattatatcaaaaatacacctgcatttgtatgttcattgcagcactattcacaatagcaaaaatatggaatcaatctctatccattgatagatgaatgaataaataaaatggcgtgtatatagataaaatgctatgtgtagatacacacatgcacacatacatgtatgtgtatatatgtacatatatacacatatgcaaacatatatataacatggaatactattcagccataaaaaaagaatgaaataaatgaaatcatgtattttgcagcaacatagatgaaactggggacattatcttaagcggaacaactcagaaacagaaaatcaaataatgcatgttctcatttacaagcagaagctaaataatgtgtatatacggacatgaagtgtgtaaaaagagacactggagactcagaagggtggtgaaggatgagaaattacttaatgggaaaaaatgtacattatttggttaatggttacactaaaagcccagacgtcactattacacattatatccatgtaaataaactgcagtgtaccacttaaatttctacaaaataaaattaggaatctttgtttataacagaatgaaaaaaataagccactgattgggaaaagctatttgcaatgcacatacagtaagaggcttttaatagactaaataataaaccttcacaaatatataaaaaacagaaaattcaatagataaatgggcaaaagctcacagattcttcaaaattaaataatactaaaatgacaaataaacatatatagattctccacttcattattattcagagaaatgcaaattataaccatagtgacctatcattatagaactgttaagtttaaaaagactaataatggaacagctggtgaaaatgtagaccaagagaaacttatggatacttcaagacatcgtgttgtatatgataaatacatacaatattatgtgtcaaatttaaaaattaaaaattaaaaaataccatctgagggatgtgagatattgaattcttaatacaatttaaattttcttaatgttgattcagattataatgatgaagataattttaacagtgatttggtgaatgataaaaaatagctagctgttttacaaacggactacttaaatgatgctataatgtaaaagcaaattacacaaagtgagatttaattaaggaggatataataatacctcacattttttgattttttaaaatagaattgtgtttagcagttgaattgtcttatttaatattcataaaagcctgggcaccagacactatcatcaaacataatttagaaataagaaaacccaccaggcgcggtggctcacacctgtaatcccagcactttgggaggccaaggcaggtggatcacaagatcaggagatcgagaccatcctggctaacatggtgaaacccgtttctcctaaaaatacaaaaaattagccaggcgtggtggtgcgcgcctgtaatcccagctactcgagaggctgaggcaggagaatcgtttgtacctgggaggaggaggttgcagtgagctgagatcgtgccactgcacttcaggttgggcagcaagagtgaaactccgccaacccatcccaaaaaaagaaataaggaaatcaagtattacagagcacaagcaacttttcctaatgttaggtctaggatttggaagtaagcagtgtcatccagaatttgtgttcttgctatatagaggaagtcaaaacaattacctaaacaaaaactgatattcaagattttcaaattaggcaaagttttagtaacttgtattgataaagaaaaactgcctagaatatcaataaagatttatgaattttcaggattaaaaggaacctaagatgccattctctagctgaacactatttcatcttcctttggacatcattgataattggctcttcattcatgtgaggctccacacattagaaaaatattcctttagtagagctgaaatttgtgttatgttttggtttgttttagcttccaatgactgaccctaactctgtccctgattaatttgcagtctaatttatattatactgggtcgttctgaaacaattagataaacctatcaagtcatacataatttcttctctaaatatttcctgttgtttcatttttttttccacatggaatgattcctgatacctttcctcagggtatgctcatttgtcaacatcccttattgataaaattggaaaatttcttaggataattgcatatataaagagataacttatgtccaatatctgggacatgataaaatctctcaaatttccttaagaattcaaagctgtgatagtctcatttgtgtgtggagtagtcccctcttgaaaattacaaactttatttgtttttaatttatgaatgtttctttatttttcctttgggacaaagaaagaaaaaagtatgcatgagcactatctttttcaatataagattatttatttaggttatatttctatgaatggaattgatggataagaaatcgtctttttggatagagactaagttgctgtaatgaagaaaatcccaaaatacaatcaatggcttaaatatgatagaagttcatttctccatcaggaaacagtataattaacagggtaaccctgcctcatgagaacttctagggagggtggttttctccatcttgttctctatcaactaataagacattgcccttatcttcatgaccaaaattatatcattgcaaaatctgctttccagtctaaagaaagcatcagtccagaacaagagatttcacttttattataaattgtaactgacctggaagctgcacacgtaaattttgttctcattcccttgaagagaatggattcaaacaagacaggttggttgtaaggaggctgaggagtgtggtctccagctgtgaagccatatgcattgcttcagctcttttcctgtgaaaagagaacaaatcaaaatttagtgtgtcaaccatctctcctacagagactacattcttttgtttccatgaatctcgaaataattttcaagattctttacaaatgattattatctttaaaatattagtaaccatattaatctgtagtgtaaaaatcaaatttttaagacaagaaattaataataaaatcaatatcgtgtggtaagaaatataattgactcattaagtaaacatctcaagttacagaaacagaagggtgtgagcatattagaaatgtgtatgttgaccacaagcatttgtgctgtcacaggctttagtgagtataatttacttaaagactagagagcaaaatttatcttgcaggttttttcaatgtggtcagttaaggcagcttctcttgtaccaacttctctgtggtacatcatatgttgctctgaacaccacattctcaaacatctgcttaaagctgtcctctagtaatttagagctcactctaaatagtcacattatattaaaataagtaattcacatttctcatgtatgctggtaatttttctagtaaatattgcttatattgaagaatcatttactaatctttttgctgttacatgaaaaagtgtttgcacaaacaaggtaaataagtggaaaccaaaatttgcatgtttagtgatttcagaggatatcaaaataaataataatgcatattgataaggtaaccaaaatcattcggcattccttcaattccaatcatagacaaagaaagcttatgctattcatttgtgacattctggattctctccacctttcatgtgcctattcatttttaagttttgctccaggatagccctattgaactgtacaatttctgaggaaagaaagcaatacatgcagcatttcaaatatatccttgctgttaaacccgagatggctagttcgcaactactcactggaacctgacctaggagagttctgtacagcatgcagccaatgggaaggaaaagtctccaccctccaggaccttaagctttagttagtgaagataaaatatactctaagaagcaactatttaccaagtctaaatcttaaagtaagccctgaatcattcatattttagtcccacatccagttaatcacgaagtcttatattctaacttctcatcttcacagccactagtttataatatttccaacagtgctgtcattcgtcccaccagctctggtcttatctcactgtaatactcccttgcagagatttctttcactgtgcaccttaactttgaaaggtatagataaaaaaaataaattattacatacgagtaacagaaaacaacttagataatgagtcagtccacatgcacataacccatctctgaattagtcaatataatatgctcaattacccactttctccacattcttatgtggcatacttactctatgctcttcaaaaaagatttatattttcagggttgaaatatgattatgtcatctccattctcagttagaatattttaaatataccctcaaaattcctaggtaagtccaaattcccttatatggttcttgaagttctggaagtggtgttaccttgctctctggatttagctgtagttattactctccatgtgtgctaaagtatgccatttaaaactatttgtagttatctaactttatattctttcttgccttggggctttggcacatgctgtttcttgcctaaatgtacccacccctttcatgttgcttgtaaattcctccttgtcttccatgaccctagtctaagaactaaagtatctttcttaaatgctcccataaaaccatgtactcatcttatcataacactgatagtactctgttgacattgtcaactccctgtttcagatgtctatgaaacctcaactccctgattacagagactatatttttctcctttctatactgagtggctagtacagtatctcatgcatagaaaatatacgataattatttgttaaattgaaattcacaatttgtggcatagattagatgcatttgtgcctaactaaaaaaaggaggaggtttctctttactaggcattatgctggatattaatgatttcaaagttaatgtgctaaaattcctgtcattccagaacacatcttagtttgttaatttctttctcttccttttttttttttataagtggtcacatttgttattattttttagaaaatacttgggataaccccaaatttgaatccatatctgcattgcaaatatggggtagagttaactggggaaaacttgaattttctcttgaaacaaaattcttatgtatctagtataaataaattgggctgacctaccaaaaagaatacatagcatggaagggaatcaataaacaattgtttgaaataaaaatgactgagtagatttgctggaataaagataatccaagggccaggtaaaagatatgaagtctatggattataagtgggatctgagtcataaaaagagatttggagaactgaagatgttgagtgactgagttttgatcaagtatataatgggttatccaagtagataagcatataatagataatttttctacaagatttataatgagcaattttaaaacatctgggctagagaaatataaattgagaaggttgaaattatagtgaaattttgaaaatacattagaacatctccaacaatgatagaacatttcagagtctaataatttcagtccttaaaattttggttaaatgttcaagctgggatgaataatttggcctttatagtctcgtttaaaagcttcaggagctgcggtggctcaggccagttgtcctggagcataaggaggcgaggctacacattcaaggccaacctgggcaacataaaaacctctcatccattaaaagcttcaaaaattgccacaatctagaacactgtaagattgttatattttctgcatgagagaattttaaaatattatttctgaaatattgtctttatatatttgagagtgatctaaagagttaataacctccaaatctgcatcctcactgaagataaaataaaatgaaatgtgcctttactgaagcagaggagattcgggaaaaattcaatcaaaaccttcccaagttagggatttctactcacatttacttagaacttcaaggaggaaagtttttgaaaatgatataggccttccaatatatagttggaacctttttatgattctattatttaaaaaaatttgctattttaaaaaatgtttgtgggaacatactagatgtatatatttatgaggtacatgagatatttttatacaggcatgtaatgtgaaataagcacatcatggagaatggggtacccatcccctcatgcttttatcctttgagttacaaacaatctaattacattctttaagttatttaaaaatatacaattaagttattgtcactgtagttttttgagaagcctccaaactgctgtccatagtggttgtactaagttacattttcaccagcagtgtacaagagttatcttttctccacaaccttgcaagcatttgttacggcctggcttttggatacaaatcattttaactggggtgagatgatatctcattggagttttgatttgcatttctctgatgattaataatgttgaacaccttttgatactcttgtttgccatttctatttcttcttttgagaaatgtctatgcaaatcttttgcataattttttattagattattagattttttcctataggcttatttgagctccttatatattccggttattcatccttgtcagatgggtagttttcaaacatgttctcacgttctgtggggtgtctcttcactttgttgattgtattctttgctattaagaagctttttaaatcgatgtgattccatttgtccatttttgctttggttgcctatgcttgtagggtattgctcaagaaattttttcccagaccaatggcttggagtttccccaaggttttctggtagtagtttcatagttcgaggtcttggatttaagtctttagttcatctttatttgatttttgtgtatggtgagagccaaatatctagtttcattcttttgcatatagatatccagttttcccagcatcatttattgaagtcttttgccccattgtatgtttctgacatccttgtcaaaagtgagtttactgtgggggtgtggatttgattttgtgttctctattcttttccattggtctatgtgtctgtttttatgccagtaccatgctattcttgttactaaagttgtgtagtaaaatttgaaatcaggtaatgtgattcctacagttttgttctatttgcttaaagtagctttggttattctgggtcttttgtggttccatataaattttaggattgttttttctatttctatgaagaatgtcattgttattttgatagggattgcattaaacctatatattgctttgagtagtatgaatattttaacaatattgattctatcaatccatgaacatgaaatatttttccattattttgtttcctgttcaatttctttcattagtgttgtatagttttcattataaaattatttcactactttggttaaattaattcctaggtatttaattttatttctggctattataaatgggactatgtttttatacttcatgctgttgatatgatagatcatgttgattgatttgtgtatgttgaaccatccttgcatcacagggataaataccacttggtcacgatgaatgatctttctaatgtattgctgaatttggcttactagtattttgttgagcatttttgcatcaatatttatcagaggtagttttctttttttgatacagttttgccaggttttggtatcagggtaataacgttcctcggagaatgaatttgggagcactctctcctcttctattttttggaatggtttgagtagaatttatattagttcttcaaatgtttggtagaattcagcagaattcagatgaagccatctggtcctaggcttttctttatggggagggattttattatggcttagatctcattacttgtcatcagtctgttcagggtttggatttcttcctgtttcaatcttggtaggttgtgtatgtctaggaattcatttatttcttctagattttccagcttattggtatataggtgctcatagtagccactaatgatccttttaatttctgcagtatcagtagtgatgtctccattttcatttctgattttattaatttgtatcttctctcttttttcttagtctggctaaagatttgtcaatttaatttaacttttcaaataacctactttttgtttaattgactttggaattttttttcaattctatttatttctgctacaatatttatcatttattttcttctactaattttgggtttgatttgctcttgcttttctaattctttaagatgcattgttagactatatatttgaggtttttttctctttgttgatgtaggcacttaatagctatcggacttccatcttagcatcgcttttgctgtatcccagaggttttggtatgttgtgttccatcataatttgttttaagaaatatttcaattttcttcttagtttcttcactgacccactggtcattcaggagcatattatttaatttttgtatatttgtatagttttcaaaattcatgttgttattaatttctagttttattccattgtggtcagagaagatacttaatatcatttcagttttttgaatgttttaatccttttttttgtgaacatattgtttatacttgagaataatccaggtgctgagaagaatgtgtattctgcagctcttggatgcaatgttctgtaaatatctattagattcatttggtctatagtgaagattacatctgatgtttctttgttgattttctgtctggaagatctgtccaagatgctgaaaatagggtgtgaagtctccagctattattgtattggggcctatctccttctttagctctgataatatttgctttatacatctgaatgctccagtgttgagcacttatatatttaaaactgttatatcctcttgataaattgatttcttatcattacatagttaccttctttgttctcttacagcttttgtcttgaaatttattttgtctgatgtaagtacagcaacttctgcttttttgttttccattggcatggaatatctttttccatctctttattttctatgtatgtatttgtaggtgaaatgtgtttcttatagacagattaatgagacttgttttttcatccattcagttactctatatcttttgattggagattttagtccaactacctcaatgttattactgaaaagtaaggacttactcctgccattttattattctttttctggttgttctgtggtcctctcttctttctctctttcctgtcttcctctagtgaaggtgatttcctttttgtacttggatattgatatatttctgtaggtttcagaagttgcctgttattattcctttgaataaatttgctccctctatttatttatctacctcttctttaaggccaataattcttagattttcccttatgaaactattttctaaatcctgtaggcatgcttcattttgttattcttttttcttttgccttttctgactaggtattttcaaatagcctgtcttcaagctcactagttcttgcttctgcttaattctgctgttaaaggaacttgatgcattcttcattatgccaactgcattttttaactccagaatttctgcttgattctctttaattattttaatctgtttgtctgatagaattttgaatttcatctctgtgttatcatgaattttctttgagtttcctcaacctacctattttgaattctctgtctgaaagatcacatatctctgtttctccaggatttgtccctggaaacttatttagtgttcatttggtgagattaagttttcctggatggtgttgatgctagcagatgttcttcagtgtctgggcattgaaggattaggtatttattgtagtcttcactgtctgggcttatttgtactcatccttcttgggaaggttttccagatatttgaaaggacttgggtgttgtgatctaagctgtatctgctttaggggggaacccacatccagtaactctgtggttcttgcagactcataaaggcaaccccttgatggtcttgaatgagatctgagagaattctctggattaccaggcaaagactcttgccttcttcctttcttccaaatatatggagtccctgcctctgctctagccacctaatgctgaggactggagtgacacaagcccccttgtggccatcattaatgtaatttcactgggccagatctgaagctagcacagcactgagtctggctgaaggcttgctgtagccactccctgattactgcctatgtttcctgaaagcacttgggctctctaatcagctggtggaaaaaccaaccaggcttatgtccttccattcagggtagcaaggtcccccagacccccagtgggtccagaggtatcatcctggagtctgcccttttttaaattaaaaataagcaatcaagaacagcaacaacaaaaaattgccagagtaaacatcatctttatcttaagcaatgtcagagtggaacttaaaacttagaaactggaacttagaatgccttattgaaagaagaacacacatatggacttaaaatggtaccaacagagagaagaccaggaaaaaaaaattaagttcataaactactctttgcattttgcttttatttaagaattattccttgcttctttcaataaattttgattgtgtgagttttcaattctccagaaattgaaaataacataatgtgctcactattcatgattgcataataaaaccacttgggtattaaaaaaataataattccttagctagaggttactgaatgacaatagaaaaaagaagaaagaatctacataagtggagacagttctcactctaagctgctgaatatgctttctgtttaactaagtaaaaagaagtaatcaaaaaacaatttccacaattttttatgaccatattcacctacctgcctctgtatgtacatactgtgttctctctcttgttctgtagatgagccatccacatggcaagcaaagggcagtctctctactatgtcccagatctcattcattcttgcctagacaagagcaatttttctggaactctctcttttctctcttgcattcttttttttctcatgagcatattaaaatgctgctatttcactctcatttgaaagtaaatatagacatacacgtatgtgtatgcatatatgtgtgcatgtgacttcaccataccctccagttactgtcccatttttttctttatttgttttacagtaaacttctcagaagagttggctatattcattgatttcagtttctttacacttgaacctgtttctatcaggcctttgccaacactactccactgacgtagctgtagttaaagtcaccagtggcatactctttgctaaatcatgagattgatagtcatttaacctatttgggctatcggcagcatttgcatagctgatcactcccttctcctagatactttctttgcttggcttctaggacacaaattcctctgctttccttctccttcactggtctcttctcattctttttcatttattcctactcatctttcatatcttttggagctcagccctttgagattcattcgtaagtaagaacaatctatctcactgctttaatgttcatctagatgctcataacttctaatttgtatattcaagtgactgcagaacagagaagtaatctcaaaatatgcacctccaaacccaaatgcccgctattatttactactttgctataaccttttctatttccactccttattcaataagaagcagctcctttccataaggcagctccttatttttgattgtttgggccacaggccttggagtcacatttactctactttttctctcatctgctgtctaatctgttaataaatcctctaggttatgccttcagaatatttccagaacttttatcctctcactgctgcattgttgcctctgttactaaaatatgagttagaccatgcctctgtggtaatcaaagccttcagtggtttacttttaacccagagaaaaagtcggccatgaaaaacatgtacaatctgcctgctcctcctcctcccactccccactcttcacctgtatgatttctcttaattttcctcctatttacactttcacccagagtcttttcattttctcttccatctgtctgaatgttcttctttcagatatttgtctgtcattccccatttcctgcagatttgagtctccttccctgacaggcctccactaaccacataaaatttctaccttccaatttccttttctcttcctcttctacacttttctccttaccatttaccactatctaacaagcaattttaactttattcactttacaaggagttctgactgttttacccactgacatatccctagcactgagcttgtggcacattttaggtacacaataaatatttattgcatattgccatattagaattactgatgaagacccaggaggctgtctttaaaggaagggattttttaaaatgaaaatgttagaaaaggtttcgaagaacaagttgcatttgaattgaggttagattaaatgataggtaatatttgagtgtgtggatgagggaaaggtacctgtggtggtgattactgagtgtgaaaagccaacgatcctcgaaaataagacatctaccaagaacaccgtctttcaatttgggtggaatttggaaggcttgaaaagaagatatgttcaagttactgggaggtaacttgggatgtataagataagcagaaagcctatttgggtcactgaggttaagcaatgaatttcttccctttcttgagcaaacaggcagatccttgatatgttacatttagatatgtgcagtagctttaatatcttcttccagaattcttccagtgacagtctttctgcttatcaagctggctaagggaaatcaaatcaacaaacctcatttcttattgaggtgggccagatacttattcatgcatatttagggaatataaatctcagttccagaatgttcgaactatagactattctgcataagccagaacataattataaacatgtagaaagaaaccactttactccaaaggtgtataatctatacatattttaatagaatttctcttttatacttgggacctaaatttgagtttagaaaaagcaatcagtaaacttacataatgagatttaagaggaaatagtcaagcaggaaattcctctcccgagcaataatttttctacttctcaatctgcacctctttttttcctgcctgactcaaaatagcaaaattctagccttaattctccaggacccctgaaggcattctcttctaatacggtgttttttccttttggttcatcttccatagctgttttgagatcagaggccttggcttccatcaccgcctggaactgacttccctcaccacttttaaaaatcagagataaatagtgaattataaaaatatgagtaaagtcaaaagcaaacactggaaacatgatcaaatacaacaagaacatcaagtgaagtacttcaaatagcacttcaggtctgtatatgtgattagatgagtttatttttagaataatatattcattgaccgggcatgtgttggcctgtcacatgctatagattattagactgacaataacccctatgacttaaggatattattagtgttagctttcaattctacttatataattattaatgattattactgtaattataaataattatttattgagcacctactatatgttaaccacttaatatgaattatcagatgtaatcttcacaacagccctcttagttaggatatattataatttccatttgacaaatgaaggaagtaaggcaaagtgatgttaagttacctgcccaagatcacaaagcaagaggtgtcagacccagaattcgaaggccatctgatcactacagcctgatttcagagtgtagagttttaactattccacaattctgcttactttcagtaatatacaacttcttcagttattaagaagtaaaagtgagagctagctttaatcaggtgcctatacaccagacaccttgcattatttcctttaatctttgcaacagttctacaaattagaattttataggtgagaaagaggttaatttagttgcccaaggtcgttctctccaaaaataaagttctattttccttaaaaacatattggaagattgtcatgaggtcaataatgttcagcaggcatacttctgcaaaatcataaaactcatcttatttacttagtaaaaccatggctaaattaagaaagagataaataaaggtgcattccattatttttcccactttcaaggtccagctcaaatgctgtattttctaggtctagttccttcattaagccttcctcaattccctgatccccaaaaccaactaatcttatatttcaattcaattaaggagaagcaagtctaatggattgggaacagatgtgcatatttttaaactgctgttgcttactgtggaagtcagacctattaaaccctccattttaaaaacctttaccctttacattctgattattttatggtacatattctgcttagtagtagtgttattgtgttgttcttattctgtcttccaaatgataagcagatgataagcaaagacttttatattcattcattcttatatcttctgtagtgtttaatacagtgcctagcatactgtatatggtcaaaaatggttataatattgatgtcagtggataattcaatgatcccacctttgattagcaattttttaatttaataatctttaaatgcctagaattaatagcaccattctctcagcttctatacccaggataatttctggacacttctgatgactttcccatgatctccggaaataataaaagataagctttacagatgaggtaacagatttgcaaaatattaaatatgccattacctgaagagggcgtaagttgagccctttccttcatctctttcttgctcacagatattacaatatctgtgcaaaaatcctaatgcaagaatgagcttagcatattccagggactgtcattaactgaaatacatatataacaaggaggaaaagatacaataaatgtggaatttattctaattacaatggaaagcaagtggagagttttaagtaataagttttatgctttaaatttttttggctgctgcatggaaaagttccttgaaggagaaaatgtgaatagagagtggtgggaatggcagaggactattgcaagagtccagttggttgctgatgttatcttggactagggttatccgtgtggaaatggtaagacaaggtaatattcagacttgccagtgtactacctgtgggtgtgaatgacaaatgtgagattcaaacccaggtctatattgcactaaagtttacaacatttgcacacctctatattccctcaattgggtatcttgtttactttttaaaaaaagacaatataaaacttataagcctagtttttcttcaggttactttgttgctttctgatttaccattcttatcgccctaaaatctaaatgtaattttagagaatatagttatacattgaaaatataagagcatgcatgggtacatggaaattaagtatcttgagagattatatctattctcaaatttacccttgacaatgcaagcagttacaccaaagagatgaaccaattactgtaaacaagacagaaagcacgtaatctttatcttttttctttgtataaataacttgcagcattccagacgtctctctcattgcaaattgatataaccacaaaaggattttgagtataatttcaaggaacatttgtttgcgatcatgcttcccacctcccaccaaaaataataataaagatcatggctagaactaacgctccaagaggtacttttaaccttaaggaagtgtagactttaaaatctattagtgaggcaaaacaaactttgtttcagctagtgctagagaaatcagacccctaccactagagaactataatgcccattaaaaataaaaattaaacacaaattgtgacattaaaaaatatgagtgcctgggtctcatttccaaaggttctagttcaactggtttgagatgaaactcacgaagcagtatttaaatttttttctcagatgattttaatgtacaaataagattgatgagaacagggcttgaggaaaataaattatgttgtcttttttttataatatcttaggatgggaattcatcctcattttccaagttaaaataactgtcttgctctggcaaaactcagacagaactcatggaaaatacaaagttttcatctgtgtgtgtgtgtgtgtgtgtgtgtgtgtgtgtgcatgcacccagaaacacacatgtaagcacacatgtagcaatggtttaaaagaggacttttagagctctacagtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataagagcattacatagttaggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaatagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattcttatttgtattctcatatttaagagtaaaggccaggcacagtggctcatgcctgtaatcccagcactttgggaggccgaggcgggtggatcacctgaggtcaggagttcaagaccaggctggccaacatggtgaaaccccgtttctactaaaaatataaaaactagccgggtgtggtggtggacacctgcaatcccagctacttgggaggctgaggcaggagaattgcttgaatccaggagacggaggttgcagtgagccaacacagtgccactgcactccagcctcggcaacacagtgagactctgtctcaaataaataaataaataaagaccctaagacaaaaaagaaagataactatctgcagtctagagatgaaaccaccttaacagttttaattatattaggttgcattttcaagtgtcagattgtcccaattcatacagtacttttactagttctcagaatgatctgtatagacagtaccatactgtgtcagttccctggcatgggataggatgtagtgaaaaaaaaatcatggaagagaaaataaattattcaagctccagttactaaattccccagtcacttaaccttttggagaatcaattttaacatcggtaaatgtaaggatcactatgaatgctttacctatctcatagatcagttgggaaagtccaatataagaaacatagatctgaaagtggctaagtgatgtgtaaaataatagtttttctattttgcaatgtataatcatggtgggtctaggattgagtctgacactgtccaaatcaaagttctccacttttctctggattacatcctctgctttttcttctggaaatttggtgtattatgattctcctaaattttcaatttctcaatttctaatggctatttatcatcagcatttaaacataatcctaaatttactgtcttaaaaaagagtctttaataattataatcctttttggctatcagcatctctctcctcccttttagagctaaactttcacaaagttgtctatcccaactttcttcatttttatgttcctttccccttccacctcaagcaatgtgaattccaacataaccatctataaaaacagaaatttctctcaaaaattaccactttctgaaggctacatcttctttaactttttattttacattgtttaccaattccttcttcctgaaacacttttgtgggggataagtgtcttccatgaaactgcattttgctacttttctttctgcctttttatctgtttgtctcggtctttttagaagcctccttctcttctgtttatcccttaaagattgacattcttcagaacttaccataggatcttcatgctcttcacctttactttcctcactattaaaatcacatctatttgcatggttttaatacacagcatgctctttcattcatctcagtttattttctcctggacttcagatgcatgggcatatccaattgcttattggatatcttcactccaatgtttcacatgcaattcggactcatcattgttctccactgcctacctcttgtctctctgtcttaatgaatgacatcataatcttctcagtgactgatgccaaatctgagttttatcttagatttctcccttccctcaacttccacaacaaattaataatgtgtcttgccaatcctacttcttaaatatctctcaaacacatcttcatcttttgatcacatcaccaccattttggtcacaactatgtctcatctaaaatactgaaaatattatccaacctatggtagcacaaaagactgactgcagtgtgtttcatggggatgttttggcatcctcattatattaattatctatcgccatataacaaactgacacaaacttagtgccttaaaacaacacagactcctactttacacttactgtgtatgtaagaattgggtatggtttagctgagttccctgctacaggatctctcacaatgctaaaatctagacgtcttatctcaaaactcacccggggaaggatctacttgtaagatgatgtagttgttggcagaattccttttgggttgatgcactgaggaccttagtttcttgatggctgctagtcagaggaagccctttatatcttgtcatgtgagcccctccataatgcagcgtgcaacatggtggcttgttttatcagaactaacaagggatagagtttgatagcaagcccgaggtcagaatcttatgtaactgattcacaaaaatgacatcccatcatctttgaaatattttattggctagaagcaggttatagaccctgtgcacacacaagaggaagacgctgcacacgaggataaataccaagaggcagaaatcaccggaggccatcttggaattgatctgccagatttcattattcctttctgcttcttaaacttcccacagcagcaaacaatgtaggtaaacattgttgcagtctacacagatgcagttttaaggaaaatccctgaggatgcagaggtaggtaataagaccctctcgtgtacttccttattatcctttatttctccttacatagccctacattgtattataattgttgtctcacatgtatattagatagagaccttggttatcatattcatcacaagtgcccagcacagagtctgctgtatagtaagtgttcaaaaaatatttcttacataaataaccccaactaaataaaatgctatgtggcatttttgctctctgtggtttacattcaaaagattgatagatccctcaaatgaataaccttaataaaacaatactgtctttatcaccactgaatttatctaaatccctctagaattatttatggtttttgcttctatcctccccagggttaatgggtactattccttaataactccatctatttgctctaaaattacctctttcttgactcaagaagatactcaatttctgcattctgatttttcaataattaattctatatttatacttctgtacccatcacaaggttgaacattacaatccaaacacttcctgattaaaatgtttcagccttattcttctgttttcatgtagaaaatgcccaatccctttggtaagttgcctggatcttctccaactgcatatcttctttagggtacaatgatcagcacttcacagttttgtttaaggaaagataaaattcgtaatgctaagttgagatacaaaaataaagatggtgccatttctcctagatctttataataaccttagttgtaaggtaaattagtggctgggctggcatgaagtctgaaatattggtttggatgcattgaatgctaatggaaaaacctgctccaggtagagttttgtgatagagtttatcttctgtgaactttattactcttttgttaacttccatttgtccataatatagtccctccctgaaggttccaaggtgcatcagaccttttttaaagtaccttatgactactaaccaaatgataaaaaactaagttggaaaatgggattggaaccagttacaggggaacatagatcccagctatgccatttgacccagtgctgataataaaaaaagacataataccaaactctgtaatcctgaatgttgaaatcccaaaagattaaattccttaaatctgaaatctataacatctaaaatccagaaaatcaccatctcggaagattaaaatcacaaatattgaaatcctgaaagccaaattctatggaaggcattagtgcattttcagttgcacacaggatagttgcatcatgttagttgcataatgttaggtgggacaataatattaccttgttattgtctttatttggaaattaagtatgatttaaggagacatgtatgggtgccaagttgacaaggagtgaacttgtggacttaattgtctgggtcaacttgactagattaaggaataccaagaaacctggtgaagtattattttgggtgtgtctgtgagagtgtttccagaggagatcagtgtgtgagtctgagcagactaggtagggaagatccgctctaatttgtttcatgcatgttttgcaaatttgattccacgaaagtgaattattacaatgtttactttttgtgtaagcaccatccaactggctgagggcctagagagaacaaatacagaagacaaactgatctctgagagctggggcaaatttttctttagcttcctaggatgtcagaactttgggctcaccggcctttgaactccaggacttacaccagtcctcccaaccaggtcctgaaactttcaatgctgaactgagaattacaccattggctttcttgtttctgaagatttcgaattttgattgaaccatactgctggcatccctgggtcttcatcttgcagacagcctgtagtgagacttctcagcctccataatcacattagccaattactataatgaagtccttctcatgtatctatatatcatcttggttctgtctctctggagaagcctgatgaatactgatttggtatttaggaaatcaaatattattccttcttactgtattttatttcttacaacataatagaagagatttgtgaaattgtttcctcacaaggaagctgtaatacaataaatgcatgaggctactcaatggtgaaacacaaaatttaaaagctaattgttattggtgctgcaaaagcagaaaatcacttagttacaatagctgagcaataaccagcccaaaaatggacagcatatacttacaaaatttgtagaccacaaccacactccaaataccagtgcagcaagtgttttgaagatcccagaagtgaaaattcaggtgaaaaagacaagaaatccctgccaaacaatttaatctgtatgacttccgctcctttacacaaaattgttgttatatatttcattttagcatcattttcaatactggaatttaaaattgtataaataattttaaagagctctaatttgtttcatgcatgttttgcaaatttgattccacgaaagtgaattatcacaatgtttactttttgtgtaagaattttgcatatatgtaaaaacactgaaaacttcttcagtaaatgaaggaaggttcttcttttatatctgcagcttttgtgaaagataagatttctctttgggcaactgcacatgccgtggtgacccatggcagtttttgatggatctcatcaaaactcaggttgcttgtcgtaatatttcacatgaaaatggttacaaactggatgcatgcaattactaaccatagtcatatatgtttatacattttggtttcagacttatgtcatatgaatacagctcattttctcataactgttatatcagtgtgactatcattagtttccctgagtgtttatgcttgtgaaaatgttttattattgcctactttattgtgtaaagtggcccataaagtgttctgtcatgtttttatatgtttcttaagtaaatattcttttaaaaatgagatacattatattttaaggaattaaaaaatttgtttttagaattatgttttccagattttgatctctcaggatttcaacaatcaggattatgccttatggattatggctaaaatctgttttggtttaatcccataggctgtgaggagccattgagagttttggtgcagaggaatcacatgatgaaaactgagcatagaaaggatgaaaaatgcatttagagattgtcactataatttcaggaagaagtaaagaggctgaagaataatgatgatgttgacaatgttttaaaaagtataaatatggccaggcacggtggctcatgcctgtaatgccagcagtgagaccccacctctacaaaaaataaaaagtgcagtggttcatgtctgtagtaccagccactcaggaagctgaggtggtaggattgcttaagcctaggaggttgaggctacagtgagtcatgatcatgcaactgtactccagcctagacaaaagagcaagactctgtcaaaaaaaaaaaaaaaaaaaaaaaaaaagggtacaaaaatgttatagtatgaacgtattgggagaaaggacattcatattggcttacagattttgaacctggataaaaatgtatccttagatagaagtaataagttctagtgtttgatagcacattagagttttgatgagatccatcaaaaactgctgtagttcatcactgcatatgcagttgcccaaagagacaagatcctgagaaatcttatctttcacaaatgctgcagatgtaaaagaacctttcttcatttattaaagaagtttcaatgtttttacatataggcataatgcttacacaaaaagtaaacattgagctaatgcactttcatggaatcaaatttgcaaaacatgcataaagcaaattataactctttaaaattctttacacaattttaaattccagtattgaaaatgatgctaaaatgaagtacataatagcaattttgtgctatgtgtagaggagcagaagtcatacaagattaaattattatttatttatttatttattattttttgagatggagtctttctctgtcacccaggctagagagtgcagtggcgtgatctcggctcactgcaacctctgcctcccaggttcaaacgattctcctgcctcagcttcacgagtagctgggactaaaggcgcacgctaccacacccagctaattttttgtatttttagtagagatggggtttcaccgtgttagccaggacggttttggtctcctgacctcatgatgcaccagcctcggcctcccaaagtgctgggattacaggcatgagccaccacgcctggccaagcttaaattattgaattaagaaattacaacagggaaataatgacagagaaaactagaggaataattagcatattatttaaatctatgcaaataagatttaaagca

SEQ ID NO: 869 - DNA, 75950 bp, Homo sapiens
ctctactgacaatcctttgagaagactccaaatatgaatacctgaatatgctgagactgtagaatgcaagagtataaaaaagcaaaaatgtactttttatcagtaaatccaataaatatatttcataagaatgatatcttccacttacaatgtatgtatatattatctaagtatccctagtgattatatgtagaggtcatttaaaagttaagaatgctcaaagaggttttggaactaattatatttcatctagaattatgtatttcacagttatacttcaaaataaaatcatcatggtagaaattgagtgattttgcattatgaggagacatcagacaatcaagacttgtttgtttgttttcgtttttgaggtggagtctcagtctttttttattgttgttgttgttgttgttgctgttgtttgagatggagctcaggctggagtgcagtggcacgattttggcttactgcagcacctgcctcctaggttccagccgttcttctgcctcagcctccgattagctgcgattataggcatgcaccaccatgcccagctaatttttgtatttttagtagagatggggtttcaccatgttggccagactggtcttgaactcctgacctcaggtgatccacccaccttggcctcccaaagtgctgggattacaggtgtgagccaccatgcccagccaagacttgtctttttgaagtaagaataatttacctaacccccagagtatctccaatacattctgaaatttatcagatagccagccacaagagagatacaacattatatatccaaaattaaaaataaaaagtaggataaacttcattattagacaattagaagtatatgcccagaacatacatttgtaaaactacgctataaaagtaatagaattcaacaggctgaatgttagatctataaacctagggtatccattcactagagaatgaaacaataagaatagtaatcaatgcctcaagagaaagctcaatatttctaacagaagaaatcctgcatatataacaaagggttactagtggcttgagaaactccaggaagcctatatagagaatgttttatcaacctccccactgcgaatgttcctgtggaagaggaagcacaggaaagtactgcatcttttaaaatcttgaagcagggactgaatatttactctcagggggtggtacacttgcaataagtattttgttatattaccaaaagaaaacaatctgaggtacaaatggtaagaaaatgttagattattcagaaagctctaaattctggaattttttgttaaagcttctgaatatctgcacatctactaatataattttagtaatatgtgtgtaattacaaacctgcaaatttgttgatattaccatgccaataaatgtttccaactcagcatttcttaaaatatggataggagaatagaaaatttatattcctccaacttctttaccactttatgaattttagtaagatagaaagcagcctaccctgaacacattttaggaaaacccagcttttcttctgtattctgacaagggaaaaacctacgaaagtaaaaaaggctaccgtctctcttgctcgaggataccacttacatttagttcaatcacaagaacagataataaagggtaaattgcaataggcaatttgccactttcctatgattaacaatcattacattgctcattgctgtgccactgtgtctgtgtatataattgtgtaaatgtttttttctgcttatccatggaatatatctagacaatttgaaatctactacctgcttgttcactactcctattgcagctaatctcttgaatgttaaatttaacctgtctatttaaagtcatgatacttgataataagtactacatttatgaagcacttattacatgctagtcatttggtgtacattatccactttaattattaccacagctttgagatgcatgaaatattatgatctttattttatagattagtaaaatgaggtttacagtgtttgtgtcatgtccaatttcacctagctaagtaatagatagaagaaaaatctgatctgatatgtacctgattactatgtatcttttcctacctcttgcactgtaccgtctcatccctccagcaagaatgacttcaaaagtttacttttgtctatttaacttggataccaataactatttcttgactttgaactacataggaattttttttttttagaggaattttgctcttttgctcatgctggagtgcagtggcacgatctggggtcactgcaacctctgccttccagtttcaagtgattctcctgcctcacctctgagtagctgggactacaggcgcccaccgacatgcccagctaatttttgtatttttagtagagacagggtttcaccatgttggctgggctggtttcgaactcctgaccttgtgatccacctgcctcggcctcccaaagtgccgggattacaggcatgagccaccacgcctggctgcataggactcttaatagtctcggacagtggctcatttctctaactattgcaaaattgagttttacaatccatcactctatatttctcaaccaaacatcttctctttagtaccatcttgtagtcctccaccatcagctgctagttattccatatagctgagtcatttaaaaaaacacagacgagaaactgaaaccacacagtcatattgacacatgatgggcctttttggataaatacaatatggcctcaagtccagattgattccaagcattaattaagtgcttatgacaagaatgtgtttgaaaagaatggattttatttggtacatgtagttttaataactacacttctatatttcaagccctaggcactatagctgcattcctctgagaattttcctcatcagaaacattgtggaattaggtactatatgacatctggtgtaaaatcaaagtatttctgagaaggtaaaatgtgatattattcaactcaacttgaaacattttaaaaatactcctatagccctggaaactttgttcactaggccattgaatgcatgctattttgacgtaatgtcactgaagagacaggagtttgattctacactgaaacgtcaactcaaatttcaatcattgttataaatttgtgcaatttatttgcattttttttctaaatttcaggaagtgctaaaagcaaatggggcaaaattatgtagtaaatccacaagttttgtgctctcctaactgcattgtgcattgtagcaataaaaaatatttaaagagaaaaccaaaagaacaaacaataccctagaaaaagataaactttttaaaaagctgaaaattgaatataaaatacaaagaagctaagacaatgaagttaaagattgccgaatgtcaggtttgggagaacactgtagcagactgaggttcagtttcagaggattaacacggaccaaaagtgttcctatgcctggagtttaatttagattcattgcttaaagaaagaaactaagaacaaatgctgctgatggctacctgtggcaaggactcataggatcgtgtgggctgaagagatgggaaaatataaacacagcctcacagaagaaataaactaagtttgaatctgtaactggctggatccacaatatccacaaagcagaaaagccaaaatgagagacctgattccagatgctgattctactggaacatgttcaaacaagcctctatatagaagatcacatggaaggacggagggagataagagaaaaaagaaaggaaacagagagagagaaagagagggatccttttcaatcaaatgagtctgcaaacacaaatcctgaattgcctgaagaaagatgcacacaaacaaaaatcaacaattagaacattaattcattccatatgaaattgattataaatgtttcataaacatattaaatatatttaagttgctttaaaggataaattaagatttggcattgataaacaatttttaaaaagaaataaaaaaaacagagaaaatgtgtataaaatagtacaggtgcatatgaaaagaacctactagaaatcctggggaaaatatagtcattataataaaaactctgttagaataatggcccccaatgaatcacaaccttcttattttacattcttttatagtatgagtttcccatttcttcacctctttaattcagcatggctttgagatttgcatagactgacagaatatgacaagaatgatattatgtgactttttatgctaggccttaagagaccttgaacttccgccttttctgtcttggaatgaatcttttgtctcgtgaataagcaactctgggctcctatgagatgagaggccacatagaagagaagtaaaaagctacagacaagagccaacaccaaccaccagacatataattgaggttaccctgaaataaacaccccagttaaggttcagataactgaagccatatatgagtaatcctaggcaagatcagcataagaactacttagataagctcaacacaagttaaataaatatatacttgttttcagacactaaatttggaatgatttgttacacagaaattaataattaatacaaacattggcaactagaaacaaggtgctgccataacaaaatcctaaaagctaggcattggctttgggaccatgtagtaggtggtctatagaaattgctatttatgtctgaaaatgtggggatcaaaactattggcaaaacttaagacttaaatagattaaaaaaatgtatgcaatgaatgtgtagatatagccaaggtgatatcccgacagaacaatgaaattgacagttggctttttgtatctgtctataataaataggagaggaggagatgaaccaaagggagtatgattcatttggaaagcagaatttagaggaaatataaaggttcaagatgtgctgggttagaaaataaaatcatttcatatttctagactttctagctgtggtcttagaataaaaatcaaaccaagtgtgtggtgataaaacctttagttaagcacacagagaaatttatgatagtgatcagtaaatccttgcaattaggcaaagaacttctatgagtttcaagggtattatctcacaaacaccttacaaatggcccaatgtaagtagaggtttatttgttaaatagttatggatgtggcttttgaacacggagggaatctcaattagattcacaaaaaattcaaaatatttaaggtagttataatgtctcatccataggaaatagagacagtttataatgaaaagaagactctgggaccccaaatctctgtggtcaggaagcagactgggaatcccctttagttgcaaacacagtccatttattatagaaaatgaaacaaatcttagagcgtggagaccagttacctggaaggcaaagtcaagaactaaggagatcaatagttaggaaactattcagccgaggaataattgggcccttactaggatgtgttttcttactatggagaagaagactcttacaacgtatacatgtctatatttcagaatttgtaagaaccagtgacttctatatgcctaattccatttcttctctctttttttttaattggaagtgtctattgcaattattctttccctgtcttatcagcacatgttgggtatattgggtgttgataatttattatttgttatttacagttttattgaggtatacataaaaataaaaattgtgtatatttatggtgtatagcataatgttttgatatatacactgtgaaatgattatcaaaatcaagctaattaatatatgcatcagctgacatagttatgctttgtttcattgtgtttttttttttctggtgaaaacacttaagatcaattctcttagcaaatttaagtataaatacagaattgttaactatggtctccatgctgtacattagagctctagaactcattcatcccacataaccgaacttttgtaccctctgactgatattttatttccttccattctacccttgtcaacaggagttctggagggaacaaatattcagaccatagcaaaaggcatagaatataagaatgtaattgtgcacagaaattaataaaacatatttattgcttgatagtctacgtcctatatgcttgatagtctacatcctactcaggaatgcctgtagctagtgaccaattattattgcaatacaaaactcagctcctttgcttcaagtcacgatacacttagaagtataatttatgctccagagtttctcaaatgattaagcattcttggatgccaccaaaattgtatcttttctgggcttcttacctacccttccttttcctgcttccctcactcttacttgtttcttctggtagtacttgctcagtaaataacttgcacctaaatctttgactcatcatctacatctgtaagaacctgtcctaaaataaacatattagtttaagaaataactggaatttttactgacgcctagaatgtggaaacttggaaagagtattactcctacattaataacagtaaaatgtcagtttaaattttaaaaattataacttttcttgaatctgtcagagaactaaggtcttggggaaaccaattagcttggaattcaaggaaagtcaggtgtctccaagcagatgagatagacacactgaaacacatatggcagagaacaggaggaaaatacatcactgtcttgtaagtggttaaaaagaatttatcaatttttttttttcgagacagagtctcgctctgtcgcccaggctggagtgcagtggcgcgatctcggctcactgcaaactccgcctcccgggttcacgccattctcctgcctcagcctccggagtagctaggactacaggcgcccgccaccaggcccggctaattttttgtatttttagtagagacggggtttcaccatattagccaggatggtctcgatctcctgacctcgtgatccgcccgcctcggcctcccagaatgctgggattacaggcgggagccaccgtgcccggcagaatttatcaattttttttatctgaaaaagctcaagtatgggctagcataagagtatagaaccgctgggaggcatggatatcaggggtcttcataatacttgcaggctattctccacagacttctaatgggagcatgattggatacagaaatcctctaacagtggtgcagacttggataaggagagcattcatcgctacacaaacaagcataaatccccatgtaagaccttctcctctatggaacaaaagccttaaattgctggggtaagggcagcacaaaccatcacccccagggcacagatgaagatgaagctagggaaggtacaagaaaaaaacaaaatatctatccctgaggtaggggtaggaaactgtcctggaccaagttcattatatgtctcctaccactaggggaggggcagggaagtctcccatacaagacctagtaaagattcacagcaaaatttggcttctatcggcagatttactaagaaaatatcaacattaagaccaagcttgcctaagttttgaaatggtacaaaaataagaaaaaaatccttttgccccctaacaccaagatcacgaacaccaagtaataagcactaacagtctactactggagagaataagaacatgacaagatccgttgtcaggtgcaagagcaaaagggaaggccaaatgttgagggtagataagggacattaagaaaaacactctggtaatctgattttcaccctacggtattgctaaaagaattttaaactggttgtacactgaaggtaaccatagtaacagcaaaatcccaaatcagctaaactcatgactaggttgactccagtctccacataaacacactggcagaagagatgtgcatctttctttcatttttctttatctttttctttttcttttttctttttctttttcttttttttttttgagacagggtcttgttctattgcctaggctggagtgcagtagcatgatctcagctcactgcagcctcaacctcctgggctcaaacaatcttctcactttagcctcccaagaagctgggactacaggtgtataccaacatgcctggctaatttttgtattttttgtagagacgagattttgccatgttgcccagtctggtgttgaactcctgggctcaagggatccacctgctttgacttccccaaacagtgggattataggcgtgagccatagtgcctggctgcgatgtgcatatttctatgcaaaaatgctatttacttcagtctcgactgtacttttccttcatgtctaggattcagtattaaaacagaaaaaaataaggaaaaaataacccacttagaaaaagcaatcatatcaattagagtcagaaaagaccccgatgttaaaattatcagggaataaatttaaaactatgactaacagtttaaaagttttaaagcatagtttcctcatcttcaaaataattttttaaagtgtcaagtgtcaaattcttatggttattgtgcatattaaatcacataatgttagtgaagtgcatacttaacaaaatatctgacacagggtaaggatttagtaaatgacagtagttgtagtcattattacctgcaatacttaataaaatatggttgactgtccaaatgtgtttgtgataaacttggtttgaataattcctattaattatgcctttctagaaacttttgcaacaataaaataaatgctgcaagggctgattggttttatttcagatgttcctaagcatatctttaagccttaccctacccactccaagctgatttccatcactccccacctccttgctccttgcttcctttgccttaactatattttttgttgttgttattgttgttgttgtttaatcaggactaggagatgaaaggcagctgaacttcgttttcctctgtgatagaaactttgatattggtaactatttcagctctctattcaagaacactggaaagtttctggtcacaaaaaaatgtcagtgacttcactgtagtctgtaccttttttcttattgtagaactcaaaattctaattttccacttattattttatttatctctatcataaagccaaatattccaattaacaccacatagtaatttaaagtactattggaatatactttaaaattattcctatttcccttgaattttgtattgtttatgtaagtaaaattcaattataagtccatattcatatactaatcagtgatatccagttgtaatgataaatgttgtttctaaaactcttttatcattcaaggggcagaaactggattacagaatccatctcctttacccaacttttcagagttttcagctcccttttatttttatgtatcttgagttatttcttctgatagattctgtgccttgaaataatcttcaactaataaaatatttagaatttaggcaatagaatgtgtctatctgtttcaatcatagactctcctctccttgtaaccagactatatttatagtatgaatattattggccagctacccataaccaacacagatttttagtatatctaataccatcatggttgctgtagttctttcaaaatgatgtatcaaaattaaagttaatgacaagtacaatgtaaaagtaaggctgcaaggtatctctgtatttagctgccctgtgttgggatatctactattggaatcttgacagcaaattttactgctcattgaagattattccacatgcacttaagtttctctagctaattcattatagttcctcattaaattataattacttttaaaaataataattattttaagaaggtgaatccaagagctgttgatatcatgtggcttattttccccatttggtgaatgtattagttcgttttcatgctactgataaagacatactcaaagctgggaacaaaaagaagtttcattggacttacagttccacatggctggggagacctcagagtcatggtgggaggcaaaaggtacttcttacatggtgtcagcaagagaaaatgaggaagaagcaaaagcgaaaacccctgatgaacccatcagatttcgtgagacttattcactatcatgagaatagtgcaggaaagactggcccccatgattcaattacctccccctaggtccctcccacaacacatgggaattctggaagacacaattcagttgcgatttgaatgggaacacagacaaaccatatcattccaccccagcccctccaaatcacatgtcctcacatttcaaaaccaatcatgccttcccaacagtcccccaaagtcttaactcatttcagaattaacccaaaagtccacagtctgaagtctaatctgagacaaggcaagccccttcaacctatgagcctgtaaaatcaaaacaagctagttacttcctacatacaataggggtacaggtattgggcaaatacagccattccatatgggagaaattggccaaaacaaaggggttacagggcccatgcaagtccgaaatccagtggggcaaattttaaagcatcaaaataatctcctttgactctaggtctcacatccaggtcatgctgatgcaacaggtgcattcccatagtcttgggctgctctgctcctgtggctttttcaggatatagcctcccacccagctgctttaatgggctggtgttgagtgcctgtggcttttccaggttaacagtgcaagctgtttgtggggtctggagggtggtggccctcttctcacagctccactagtccagtagggtatctgtgtgggagctccaaccccatatttcccttccatactgccctagtagaggttctccatgagtgctccacccctgcagcacacttctgcctgtgtgtccaggtgtttccatacatcttctgaaacctaggcagaagttcccaaacctcaattcttgacttctgtgcatccacaggatcaacaccacgtggaacatgtcaaggcttggggcttccaccctcttaaacccaagctgtacgttcgttggcccctttcagccacagctggagtggctgggacacaaggcaccaagttcctaggctgcacacagcacagggaccttgggcccagcccacaaaaccactttttcctcctgggcctctgggcctgtgatggaaggggctgccatgatggtctctgacatggtctggagacattttccccatggtcttggggattaacattaggctccttgccacttatgcaaatttctgcatctggcttgaatttctcctcaaaaaatgagtttttttttttctactgcatcatcattctggaaattttctgaacttttatgctcagtttcccttttttttttttttgagatgaagtcttgctctgttgcccaggctgcagtgcagtgacatgatcttggctcactgtaacctccacctcccaggtttaagcgattctcctgcctcagcctccgaagtggctgggactataggcacgtgccaccacacctagctaattttttgtatttttagtagagacggggtttcaccatgttagccaggatgatctcgatcttctaacctcatggtctgcccgccttggcgtcccaaatgctgggattacaggcatgagctgcgactggccccatttccattttaaaattgaatgcttttaacagtacccaagtaacctcttgaatgctttgctgcttagaaatttcttccaccagataccctaaatcatctgtctcaagttcaatgttccacaaatctctagagtaggggcagaatgctgccagtctctttgttaaaacagtaagagtcacctttgctccagttcccaacaagttcctcatctccatctgacaccacctcaatctggaccttatttttcatatctctatcagcatttttgtcaaagccattcaacaaatctctaggaggttccaaactttcccacattttcttgtcttcttctgagccctcaaaaatgttctaacctctgccagttactcagttccaaagtcgcttccccattttcaggtatcttttcagcaacaccccacactactggtactaatttactgtattagttcattttcatgctgttgataaagacatacccgaaactgggaacaaaaagaggtttcattagacttacagttccacatggctggggaggcctcagaataatggcaagaggcaaaaggcacttcttacatggcagcagcaagagaaaatgaggaagaagcaaaagcagaaacccccataaacccatcagatctcatgagacttattaactatcatgagaatagcatgggaaagaccgaccgtcatgattcaattacctccccctaggtcccgcccacaacatgtgggaattctgggagatataattaggttgagatttgaatgggaacacagccaaaccatatcagtgagcccccacatcagtggcaaagttaggattgcaagcccaggtcatgtgactccagagtccattctcttaactactctgctatgctgtctcttacaatactttctaggccgtctaactgccactaattgtatgacctttggaaagacccttaaattatcaggaccactgctttcacatatgagaaatggggataataataaaaattattacagtgctgttttgagcattaaatgagttaatgtttgaaagcacttataagtgtttgacacactataagcactgtaaaggtgttggctaaaatgagttcttttaaatattaccttacaattatcttattggtatcagttaacgtttttataagtagattaaaagtttgtacaatttataattaaataaaagaataattgttagtccgtggctggaataagttaggactttgacattaaaaccccttatagttgtgtaattacttgcctgacaatactgagtaagcatgtggctactcaaatcctttataaaagaaattctcgtaatttagtgatattacttatgataggtagcattcactaggaatttagtatgcttcacaagctattcctaatactaaagtattaattctaattaccagaataattccatggaataggtactactattatcaccattttagagataagaaaaataaagcacagagaagtagctccaaattcatagagtaactggtagagatgagacggaagaatttatcatgtcctaagcacttccaatttagccagttttccactcttttcttctcccagcatcgtaaaatctgactgataagtataaataaggaagaaaaaataacatttattctctacaatatagtctcctcactacctgatgctaaatatgaagggacagttctaatgaaagtgatcaacaagttctagaaggaactaaagcttagttccttcctcaacctcagtgaaaagaacaaggttattagtggcgatgtttttcctaggtgtgggggagctaagcattttgaacacagcaaagataaggaagtcggtctgtaatctgcaaaaaggtaagacatttattaaagcattaatcttacctagactggcttggattttcacagtgatctcttgctcatcatgcattttaacaccccttgccacacaaccacttctaaattcttcctctaaaggtaaagagctgtatgttctgagagtaaggaggaaattcctaaaaaagtatctagaatctagaaaattattctctaggtttatgcctcatacatgattgcaaaccatagtgatgatgagcatgtttgtagaactgactttaatggtcttctacaacaattcaggctacatctgcccagagagtgtgtgtggtccacatgttctttcaaatggagaggacctaatcattaagacatagcttttttttttttttcttaactttcaggagtcagatgtggaggatatagagagaattttgacttttagtccatgttgttttccctgacacattttcaattacattgacaactaaaaaacaagaccttggcaagaacatcagggagaaatggtgatgagatgaaaagatgctcagataggcagattttgatatatgactggtcaacagaccttgggaggctctctctacaatgagaacagaagcatccttgtgctaaaggctcatctgcttacaacggttgagataaagaggaatttctcgagctagtggaagaaacaggatgagaagtgtgaaaggaaattaaattttgggattcaaaactcatttagccaaagggaaaagtcaagctgtgaactggatcatgcaaacctgcctccacctttcagttcctaaataaaatggctacaagatgcaaagctactcacctttcccatattttgccaacaaggaaattcctgatgagctgttaaaacttcaccatggcaatgctaattgatagcttatctttataggtgcagtcactcagcctgccagacacaaatgcatatcagattgttcccctaccccattttatttgtgtaatgtaaaatgcagatttcccacatttttcctttgccccttttaagtgaaaactgtgtgcttctcaatatcctgccctttcccctttaaatttggagccctcaaaatcatcttaagagaaaggcatagacctgactcctgggcgtgtccttaactttggcaaataaatctccaaaaatgattaagacttgtcttgtcattttcttcgattcacagaaggcaggatatacaagtagaaagcagaaggcaggatgtacaagacatcactctaaaacctttgaatcaacaaatgaatagcagaaaagcagatgccttgacattgtccttttaaatacacggactcaacaaatatcattgccagctcctaatatgttaggccttgctgatacattggttgactagaaagagtttcctgtcccaatggagctgatattgcagaaaaaagtaaattgtacaattaattacaaatgtgttgaatgctttgaagaagtatagatcattttgagagcctccataatggaaaatttaacctagcttagtcaaacaacacagaaaaaggcatttaatctaaggcttcaagcatgggtagacttcagcttttcaatgtgggcaaaccgatatagagaattcaggcagtgacaaaaaaaaaaaaaaagtagccttaatgtctcactcacaaagctaaatttatggttgaaaatgttaatctatcttctctcatccagaaccaaataaggattgaaaatgtatattttcagaaggattatgttaatgaatatttattgcatgctcttcctgtgccaccaaaacgctaaactctttatattcaacacattatttaatccaagcagtagcctatgtggaatgtgctatcattccttccattttacacatgaggaaactaaacatcaaagcatttacactgtatatatatgataaatccaggaattcaaataaaggtctccctagcacacataccaaactccttccacaatgcttttccacatttattagaagaaaacaggaacaaaaaaagcagtactcaataaaagcaaaataagttaccctggtgaaaaggaatgctgggaggaatgcttttggctatttataatcatacctacatcctcaaaaatccattgccagagtctatttccctgtttaacaatttgtgaggatccttagagaatcaacagcaggaggcaccactgttcagcccattagatatgatccaagatttgtctcagtgcctgactcttctgttctctagtaaggggtctatcaaaacccaatgtacttcatttttagcagaaaggacacatttcccaggggaaattgaaggtgatccttctcaaagtacaaatctagctgttttttgagatgcgatatatcgatgtctggatgaccatattgtgcaagacaattctcttcaggcccaaagttcttttcatatttacaataaaggaatgctatacagaaaaattttcacaaagatcaaaacaattcaaatagattatgccacacaatttcagtgaaaagaaagcttcaacatttacccaaagcatcatcagaaaaccacacttgctagaagacttaatgtctctcatatcacccacagagacatgagtgagtgatcattcccagaacgtgctattcaaagaaaatccattcatcttgttactagttgtcaacttcatgttttaaatctcatttcaatcacacaagaataagacattttctacacctcttagtcaatgaaagagaaatcaatacatgctttttaaaccaaaaatttatatcttcattactgagagaagtcaaaaacagaattatcttaacagtaatagtggtatataacacctctcctttttatttgtttgtgattcttttgttttcttacatagcatataaacagcttagtttatttttccttctactaagtcttcataatcatctcccttagactgagttccaaactctttggaaactactgatgcgttaattggctttttaaattatcttaaaaatataaactttattaattaccacatatgttctttcttttaaatattaatgacttggccaggtgccgtggctcacacctgtaatcccagcaatttgggaggccgaagggggtggatcacgaggtcaggaggtcgagatcagtcaagccaacatagttaaacccatctgtactaaaaatacaaaaaattagccggttatggtggtatacacctgtaatcccagctatttgggaggctgaggcaggaggatcgcatgaacctgggaagcagaggttgcagtgagcagagatcacgccattgcactccagcctgggtgacagtgtgagactctgtctcaaaaaaaaaaaaaaaaaaaaaaaaaatatatatatatatatatgtgactcttcatcaagtagtttctatgaataaaatcagatttcacaaactctgtaaagtgggagaatgaaaatctagtaggttttacttatctgccacaactaaaaattagtatagatttgaggaaatgtcattttgttttgaagagtgtgatttaaaaaaaaatatatatatataatatatatatatataatcttaatttgctttgtcactcatataaaggaaaccgtagttgagttgtagacaatgaggaaacacttgaggcttccgctgtatgtttctttgttattgttatgttgttacccagtaacttgaatattgtttaaagtgttgtaagacattgtagagtttatctcaagctgttaaaaatggtaatgtacaaatgtgaatagacacttatctatataatatgggtaagttttgttttgcctataatagatgtttataaaacaagtgagggagcagttggtatttttatttccttttctttctttctttttattgaaaaatcaagattgtataaaccaaaagctgcaagatgccaaaatcttgtagatgtcaaataaaaagttattttactaaaaaaaaagtgtgcgttggtaatcactactattaataattttaaaaaggataaataaggtcatataaccctgtctctggttcagcaatttggaaaagttgtagttagaacaggagactgttctaatagagagagtgaagagtacaatatgtagtttagttctctcatttggtaggtgcagacacagaaggaatgaaaggctgcatttacacgattagctagatctgtacaaacatttagtactttaacttttctcaaagccttttatgtattatcctatgggtaatgttatcccaaatgtatggataaaattaaaacaagaacactaaatgacttcacaaagacctgaaaggcagatcaacggcataactaatattaaaactcaggactagtgctctgaacatcaaacctcctggatgaggtcttccgtggcacatctctcatttgttgaacagtttttaaaatactgtgtgctgggctttaggttgagagataggacacgtgatttatcccttcagggtgtttgcatcataaagaggcctgtgatcttcaattaatcatgtggccaaagttatttctaggggtcagggagtcattgacaattcattatgccaaatgtgccaaaatgccgaaaaaaaaaaaaccaaaaaccaataatgtaagtctcctgaatataaaattttcaaaaactgaattagaaacatttttttttactctagcaagagcaattcaataaaagcagacatataaaggataattttttaaatctgtgaccaaaattgaatatgagattgattcatctacaaagtgtcttacttttctgtagtacaataaaataaattatactgtcctagacaggcaaacttcaatataagggagatttaatgtcgtctgtcctatcatagtgaaatttgactccactattagtttctgaatactttcatgatttccctcctgctagtttaccatgagacaccatctcagacttctacacagctcatttgcacccatcacaatatataaataaacaggagtgtgccttttctctgccgtatttccactcaactaattcctgtatctttcagctccaccagttctttgtatacttgcaaataatggctgaaaatatttatattttttcttgacttcatatttcttctacacactattagttttcttactctgtaatttaagtgacagatttggagtgggacaaatctgtatgaaaacttataaattaaatttcccatttaatgagaagattttaagtagaggttaattggtaaattactttctcccttttcccccatgctcttttcatattctgattgcattatatgtatgtatatttctagttatgtgtacaactatacaaaatttgggaatataaattcatttcattaacacctgtaccctttttgctcctactcaactcttttttgcacgcaattcagcaaaacttttggaaatagttgtccatattcactggcttctctttctcattttttcacctctcacacaatcctttggaataaggttttcatcttcataattccacagaaacggggaacactcatgttgccaaattcaatagctacctctctaacctcttcttattccatctcttagcacacaacacagttgaccagttgctcatgccctgtttctttaaaaactcctttttcttggcttttttgaaccacacttgtctgtgacagccaccactccttgacagctgtgctgtctccatttgacctctaaatgttaggactgatttgtgttaatagaattataggttacggagatggagccctcacaaattggattagtgtccttataagggccaaggaaaccagagctcttcccctcaactatgtgaggacagagtgagaaggttccttctgagtcatatagtgggtgttcaccagataccagttttgctggtgacttgatcttggacttctcagtacccagaactgtgggaaaaaaaatttggctgtttataaactactccacttatgctattttgttataattgctcagagtaagaaatgaagatatttcatcttacttatcttattattgctatttctccagctttggacacaatacttagcactttgtggaaactcagtatattttttaaatgaataaatacataaatgaattcaccaaataggtagttaaagaaccataaaaatcatcatatccttgttttcgaagtgaattagaaccagctgagttgcacagaattgtaaatcagaacatcttgctgatctttatctctgcatacagacctgattttcatagaactcactgtctgaattacatgtgacaacagatacaaggatgtagatttcactttattttgcaaacatgaatttcatcatctacatagtggatagttgattctccagtgaagtcagatttctgaagtgttaatttaatattgtgctattatactttaaaaaaaaaaacatagcacacatcttctagtaaaatggcacatatctttttgcaatagtcaggaactacagacatgagctaaatcatgtatttgaaaggtagtcccagagtggctaagtcagaataaggtatatctttctttctaaagtactgctttgattatattattttctgctcctcaatccacagtagcacctattagcagttctgcctttggcaattgacatatgttatctcctgttgctatttatcaatttactgtcagttatgttctctctctccaattggactgtaggtttttggcaagatgcaatctggaagtaagctctatcaaaagtagttattgaatagatatttgtaaaagattacgatgaaaacatttctaactctccaaatctaactccaccttatctttagtcttaaacacaacgtgaaaattaaactaaaaacattgaacaaattaatcttgacactgtaatatattgcaatggctaaaataattttgaatcctaaatattaattttgttatacatcttttttatatatatttccctgtatggaacatgttatgaataaatacttgatgttctttacacagtctagagcttgctacatattgttgatcatctcagaaacagcttaataaaatcagcatttgaaaatcccagtatcagcacctgtgacattaataattctggtgaaacaggtgcttcctgggaatttcaaacatttgaaaataaagtgataggccggacgcggtggctcacgcctgtaatcccagcactttgggaggctgaggcagatggatcacgacgtcaggagatcgagaccatcctggctaacacggtgaaaccccatctctactaaacaaaaccaaaaaaattagccgggcgtggtggtggacgcctatagtcccagctacttgggaggctgaggcaggagaacggcgtgaacctgggaggcggagcttgcaatgagcctagatcgcgccactgcactccagcctgggcgacagagcaagactccatctcaaaaaaagaaaataaagtgatacttcgagggaattagttgtgtcacagataaaaatagattgtgcttcactgcactcattttaaaacatagtgactgtcttcaatgctactttacaagtgaggaccagataattaactgaagtttctttctcaagcctgattgcgttgtttctttttcttcactactcttctcctttactgtcccttcaccatttaggaggaggatatgcttttctacacatctgttccttaggaggatggttgatacagctaccaaaaaaatttgtttcatgttttaaagtaatcatcattctcagtaaactatcccaaggacaaaaaaccaaacaccgcatgttctcactcatagatgggaattgaacagtgagaacacatggacacaggaaggggaacatcacactctggggactgttgtggggtggtgggaggggggagggatagcattaggagatatacctaatgctaaatggcgagttaatgggtgcagcacaccagcatggcagatgtatacatatgtaactaacctgcacattgtgcacatgtaccctaaaacttaaagtataataataataaaaaatatgctttgcagagttaaagcaaagaaaaagtcgtaaaagacaaactatattttgtctgtgagagccagcttgttaagacagaaaagttgtttcttttttacatttctaaaacttggttttaaatgtgaagagacaaatactaaaagcaacagaacttaaggtttctctgtaaacaaatgtgtttgtttcagtcataccagatattatgacaaacaaatgctaagtttatgagatttaaaaccatgaaagtatatttttgaatgcattaaaataccgtgaaggtgttaatggttcgtaactgggagtggcacaaaggccagttctgcctcctgaaatcattgacagacactgagctgatggaagatttgtttttttaaatatatctcttttaagatcatcgtgggtgttaacaggtagccaagaatgtaagaaggagaatattaaggttgtacatttgcttaactgccttggtctaggaaaaaaaaaatatcttccatgtactttttagcctgaagaagttacttgaccccagtcagataaaaagaaagctgacaaataaccatatcccaggaataactctgttttctacaagaggactaaaacaggaagccaagggaatgagtctgtggttatcattttctaaaaagtgggctctgtcccctgtcaatttctgaagttgaaattttagaggtagagagaaacagaaaccaacacataggtatgggactcagagaccagagagtgtttgtgctcaacttgctttatggaactcagaagagatataatctcatggagaattcactgctcacacaggctagcatcagcagaattgtaatggtggcaaaacagtatagtccgatatatagattgaaataggacccatcctcagtctatcagaggtccttaacgatgcaggagatcatctgaaaatagcttgtcctgtcccatattgattcaagataggccagagagaccttttagttgcaaaggatagacagagtaaatagcaagtacctaatgactggagaacagggtagcagcatagacatggatatcaagcttaagtagggataagtgttgacaacctacggtatgctggcattggtggggtgaggttttcttctccttagaaaagaattcagttaaatagaggtatagaagaataaatagaagtatttaatgatatggcttagcttggtggtttgaaatacatgcctgctacatctggattctgaatatttctgtatttgtaaccatctcaaaaactccagggtattaataaatttgtccataaatacttaacaattggaaaggcatatggctttagatttaccttttcatttcaggattttactcattaaatcagtattagatgctgcagcataattaagttgaagctgacatttgagaacattatttgtttttctctttcatgacatctaaatacatttgatattttttcccaattgccaatcaagtattcttccactagaatttacttttacctgattttaaaagaacattccaatcatggttggtagccatatggacctctcactcaactacaatgtcagtggctctgggagctatttgtctgtgtctgagtgataaaatctttctcagttccctttgagataattttcctctcattttctactgccaaatggacaatctttggatttctccctgaagtggtctttattctcaagtgaccttcaaatggtttacctctgagatattcccacagcacacccaaagtgaagatatagccccttcaaagttggcaacaatacatctagaagttttctcatggtggtaaaatagacaataatttcattttttctaaatagactcactcaagtcaatatccacacagcttcccacacacaataacccattccttttgtatacccttggtgccttagtctaggtcttttttctgaccatagcatccttcattatcttttcagatctcacttctttcaacatcaagccttcttatgtccagtgataagatttatgtctttttgtaagaattttatgtatttattaaaaacatcatttaattgacttaatcagtttcattgggattacttttaaatctttattaaagatccttcagagcaagggccattttatacatcttttttggtaatttttctatattgttacctaagttcacattatcatagagattaatcagaccacacaaaacagtgaaattgatagtgactatagagttagcctgagtgttcagtacaggatgactggctccttttgaataataaagatgatctctaaaataatagcatatatctcattaatacaattatgatatcttgaactgtgcaggacaaacagtcctatttttattatatgaaatagtctttgtaagtatctaattacctacttcccttgataacactgaaaaaagaccttgaatcttaaaaatttccactttaaagtaagtatagtgcaaggacagatcaatgtagtactatgtttttatgccctctctgcagcgagtttatatataacctgaacttttcatagctcccaaatccaaaaaaaaatgcttgcaaccataatttactttttacatttaaactatcgacaataacttcatagcactggtccagttgctcatttcacttgtgaaaggggtcaaattttcacctagagttttattgaatgccacattttatagtaactgttactcaggcttattgtttctcacagttgtttgtttatttttgtgtgtgtgttgttttctcctatgtttatcatcacggttgcttcctgaggaacttttgctagtcgtcgcttcaaagtaatatctccttttcaagaatgggtaacttgataacaatgaaacaatcaaggtattgactcagaaagacttaaccaatgtaaacacacttctctttactgatattgtcttagtttgggatgctgtaacaatataccatagactgggtagcttaagcaacaaacatttatttctcacagttctggagattaggaaatccaaaatcaaggtgctggaagatccagtgtctggctagggctttcttcctggtttatgattgtctgtcttctcaggataacatcacaatgcagagagagaaagagatctattctctttctctttttttaaggatgctatttctatcatggagtctttgccccgatagcctcatctagccctaattacctgccaaaggagacacctaatactatcccatttggggttcgggtatcaacatatgaatattgggtgggcagaaatatggattctataacagagatgtacagtcttcaaaaatgattagaatcaagatagagttagaaataatttggttacaaatgtcagaaactcataacaaacttcataggtaaaaggagaatttactggttcactaactgtaggaaggaaagaactaaacttcaggtacactggaaccaaagaatttgaggcaaactaggctcaatcttcaattcttagctctacttccctctatatgttgccattattctttctgaccagcttcattacaagagaatggttgaggttaactttggcaccaagttaaataactataaataattaaattaaataatgtaatttaaataattaaaaagttaaataattagctttccatggatagaatactccttgctgatcaatgatgactgcagtgatagctacagtacgttaacagcagcacccatcagaaacatgattcaagttggaatgtgggtaaggaagctgatatttgacatagcagatgatagatggtcaccgttgggacttataaatactttaaatcagtattaaaaggacatttatatattgacactactgatgaaataatagttttatatttttgtttagtattccacaaatgtatcactactatataaaatatggtctcttttatataattacttaattcaaggaaccaagaaggaaaaagattatttcaaatctatataatgtaatggtcccatttcttacattttcagtcttcatactgtgaagtcactaaccgtaactgttgtagtttattttccacaatcacttaggtttcttgtttatcaaaaataaaactatcaaactatcaagctcagtaaataatttatatcatttgacagaataataatcttaagtaaaagtggccttaatatagatagatatttaggagaccaataaaaacactaatccaacttaagcaaaatgttaccaaaaataactcagattacagttttaattgttgttttatttatttcaaagtgattttttgtgaaggccagacatacttttattctgaacacttagaaagagattatcttaacatactgatatattaaaggaccattgaccagtatccaaaaatggtactaatttaaataaaatatttatctactgagttctataatatttctctttagcataatgggacagtggtatattaacccatgataattttcattattactttccatgttgtccccttatcaaacaaatatcatataattcactatttcagattatacaggtttgcaaatatttaattttagacagtagaagacaccttaatgagctttttttcataaaatacattatgactaaccttcctctgaaggatttattcatccaaaaatatagctgagttcttactacatgctagcatactccagttgcttaagatagaaagatgaatatcaaatagtaaataaagacaagcagtattcagagaaatagtttcactagactcactctgcctgaaaaagctaggtacttccactttagccatcagacctggtatgagtcacagttgggtacaccagggagcagcccataaaggccctgctgtgagcgttctagtatagcccatgacatgaggataggcttaatattaagaatggacactgagactgatgcttctgtctgcctcatttaaatacaaaactgcaaatatttcctttaatttgtatgcaacttacaccttatcacaggacactacaataggaaagtggaatttatggtgcccccttcccaattttgccaaaattggggagtttctctagaatagactcatcagcttacaaattccctttttgaatggaaagcatagaagtggagcaggcccctgtaggaatactaattttaactgtctatatttcgcatttacttttcaagatggaaagtactagcacgtgttttcaggattagtgaaaattaaccaatacagggaaagaaagtgataacactgtggaaagcaggaaaaactacagaagcaaatgtaggaaaaggtaagaaaggtgaagggttctgaaacacaagtgagcacttggatatcatagaaggagggcactttttcaccttaacagggtaagaacagcaacgaggaagatgctagtacaactctcaatttggtaatggcaaggtaagggagccctcttttgatagcttctattttattttttattaagcataaatatattatctgcaagatgaagagaggttttagaagagaagagaaatttctttactcattagtcgattggcacttgggttgattccacatctttgcaattgtgaattgtgctgctataaacatatgtgtgcaagggtccttttcatataatgacttgttttcattgggatatatacccagtattgggattgctggattgaatggtagatgtacttttagctctttaaggaattttgatactgtcctacatacaggttgtactaagttccattcccatcagcagtgcaagctgctttttccctacatccaccccaacatatattgtttttcgacttttcaataacggctattcttgcaggagtaaggtgctcattgtggttttaatttgcatttccctgaagattagtgatgttaagcatttattcatatgtttgattgctgtttgtgtatcttcttttgcaaaatttctattcatgttctttgcttactttttaatggaattatttggggttttttccttggtgatttgttggatttccttatcgattatggatactagtcctctgttggatacatagcttgcaaatattttctcccattctgttgatcatctgtttactatgttatttcttttgccgtgcagaagctttttggtttaattaagtctcatttatttattttggtttttgttgcatttgcttttgtggtcttagttataaattctttgcctaggccagtgtctagaagagtttttgtaacactgttttctagaatctttgtggtttcaggtcttaagtttttgatccattttgagcttacttttgtatatggtgagagttaggaattcagtttcattcttctacacgtggcttgtcagttttcccagcaccatttattaaataaggtattccttcaccaacttgtgtttttgtatgctttgacatatcacttggctgtacatatttggctttatttctgggttctctgttctgtgccacgagcctatgtacctacatttataccattgccatgttgttttggtaactgtacccgtgtggtacaatttggagtccagtaatgcgatgtctctaagtttgttcatttgcttaggattgctttggctatccagcctctttttaggttctaaattaattttaggcttgctttatttttctaattctttgaaaaatgctgttaggtgtttgatgggaattgcactgaatctgtagattgctttggcctgcatggtcattatcacgatattgattcttccaatgaataaacatgggatgcatttccatttctttgtgtcagctatgatttctttccagagtgttttgtagttctccttgtagtgatctttcacttccttggttaaggtatattcctggatttcttttttatttatttattttttattattgacagctgttttaaaagggattgaattcttgcttttattctcagcttggtcatttttggtgtgctactgatttgtgtacattgattttgtaatctgagactactcaattcatttatcaaacctaagtgtctttggaggagtcttaggattttctaggtattcaatcatattatcggcaaacaacgataacttgacttcctcttttccaatttggatggcctttatttctttctcttgactcattgctctggctagtatttatagaactatgtagaataagagtggtgaacgtggtcatccttgtcttgttcctgttctcagggggaatgctttcaacttttcctcattcagtatgatattggctgtgggtttttcatctatagcttttattattttgaagtagttttcttctatgcctagtttattcagagtttttatcataaaggggtgctggattttgttgaatgatttttctgaatctattgagatggtcatgtagttttgtttttaattgtgtttatgtgatgtttttaattctgttttctgtgacgtattctctctcgatgaatctagctaatagtctatcagttttattttttcaaacaatgagttttgcgtttcattgattttcatatatttttgtgtttgaattttattgagttctgctctgatctttgttatttcttttcttcttctagctttaggtttattttgttcttgtttcttctgttccttgaggtacgacattagatcgtcaactgtgcttttttagactttttgatgtaggcatttagtgctataaagttccatcttagcactgcttttgctgtactcgaggttttgataagttattgcactattattcaattcaaagaatttttaaagttttgtcttgactttattgttaaccagataccattcagaagaagattatttaatttccatgtctttgtatagttttgagggttctgaaactgcctttgcaaaattataactgaggaaattatgacagtgcagtgaaataaatcagaacttactaactctatcttgcttctaacccttaagctgtccttgttcattcctgggtgtaggctggactaactttgggaaggaatttagttcatggtttgactctgaaacaaaactgataacaaccctttcttgcctggtgtccagtctgctttttcaggactaataaattagctacaagattaaaaattataatttaggggtcatacagcctctggctccaagagtctgaaaatccacaaattgctcctagggataacaccactattgtaaaacctaagatcagtgcttgagatattttgcagaccctgaactccatagatcagccaacaccacccagaccagtaatctggcccaaccagttctgccaatgcacccaagtacagaagacattaagaaaacctaactttgacctcctatggttccatctccaacttgaccaatcagcacttcccatttcccaagcccctacccaccaatttatctttaaaaagtctgattcctgaattctcggggagactgatttgagtaataataaaactccagtctcccgcatggccagctctgcatgaattattttttcaccactgcaattctcttttcttgataaatcagctctgtctaggcagcaggcaatgtgaaccaattgggctgttacagttctttgtgaagttgatttctagttttattctgctgtggtctgagaagatatttgatataatttccattttaaaaaatttattgaggcccgttttgtgacctattatatgatcagccttggagaatgttccatgtgaagatgagatgaatgtgtattctacagatcttaaggtaaaatgttctataaatacctggtaagcccattagttctagtgtatcctttacatttattgtttctctgttgactttctgtctcaaagatttgtctagtgctgtcagtggtatatagaagtctctcaccattactgtattgctatctcattacttagatgtagtagtaattgttttatgaatctaggagctccagtgtttggtgcatacatatttaggattataatatctacttattgaatttatccttttatcacatatgtagtaatgatctttgtctttttttaaatttttgctgctttgaaatctgtttggtcttaatatgagtatagctgctcctgctcacttttggtttccatttgcatggaataccttttcctacccttttactttgagtttatataaatccttccctgttaggtgagtctcttgaaggcagcagatatttggattgtgattttttaaatccattctgccattctgtatcttttaaatggagcatttaggtaacttacattcaacgttaatattgaaatgtgaagtactgttctcctcatcgtgttaattgttacacagatagtttcttttcattgcattattgttttataggccctgtgagttttaagcttttaagacattctattttgctgcatattgggtttttgttttaaggtttagaacttcttttagtatttcctttagtgctggtttggtagtgacaaattccctcagcatttgtctgaaaatgactttatttctcatttatgaaactaagttttatgggaaacaaaattcttggctgacagttgttctgtttaagaaggttgaaattaggaccccaatcccttctggcttgtaaggtttccgtggagaagtctgttcttagtctgataggttttcctttatggtttacttgatgcttttccttactgttcttagaattctttctgttgactttagatagcctgatgactatatgtcttgctgaagatctttttgcaataaatttcccaggagtcttttgagcttcttggatttggatatctagatctctagccagaccaggaagttttcctcaactattccctcaaatatgttttccagatttattattttcacttctccctcaggagaaggaaagccaattattgttattcattttatgtatttccatatttcttagagactttgttcatttttattcttttttatttttgtctgattcagttaattcaaaagccttgcctttgagctccgaaaattctttctcctagttgttctagcctattgttaaacatttccacggcattttataattattgcccaagtgtatcttttattttcagagtttctgattaatttttctttacgatatcactctagaaaatttttcattcatatcctcaactgccttctaaatttctttatgattttttttttgcctttctctgatatctccttgagtagcttaataatcaaccttctgaatttatctggtatttcaaaaatttcatcttggttgggtccactgctggagaactagtgtgatcttttgcgggtgttatagcaccatgttttgtcatattaccagagttatttttctggtccttctcatttgggtagactattttttctaattattctttattttacatttgatttaattgtgtttcctttgtttgtttgcttttaatttttttcctctttaaggatgagacttcaatgctttgagttaattgtagcctaatttggttcttggtgctttcagggtcaaagactctgaagagtcccttggttatagaaagtgtttgtatgatggctttctcatatgctggtatagtagcaatgggctcagtgtggaaacaaattcagtatctcctatggggttggaatggtagaggtctcttaaagcttatctcattcccctgtggtggcactttatttatttatttatttccccccatattttatttactggtttgatggttcagatttcaggccagtaggggaggtatccctgggtagggaccagttgtaggtaaagcaggtggataaataaagtcccagcattgacagaggtaagtggaggagcttaagtgagttgcactgaggttttatcaagtgaagttttggaaccactttagctccctgccaggtcagtaggaaagttatccacctctcagacatgctactatcccagtgttctggttattcagatcaggcaggcacccttttcatctgtagaaatgttgaccttccaagtagagaggaattgtgactctgtctctcatgcaagcctgaacccaggtagtgctccttctgtggggatgcagtaccctgatgtgttccagaaatgctgtctatggttgcacccatactgagctcctgttggagaaacccaaactgcgcctatgatggtggataaggggggaaaggcttcctcttctccagtactcttcatggataccaggactgtctgactgttggaactgtctgactgagagctgaagaccttccctgcctagccccgcacctcaacagtactgctgctgaaggaagctttccaccagtggaaggatcctgtggtcaaggcctgccatctggattcttttgtcttacagtgtgttctcttggggttggaatggtagaggtctcttaaagcttatctcaatcccctgcggtggcactttatttatttatttatttccccccatgttttatttactggtttgatggttcagatttcaggccagtaggggaggtatccctgggtagggaccagttgtgggtaaagcactctcccttcccctaggagtgggaatccctgggagccagactactgtgggtgttgttgctcctctgggtctagctgctcagtggaattgccccactccaggctggtgttggggaaatgtttgcaagggatccactgatgtgacctgtcctcaagttttctagcagtgggtaatggcaccagctctaatgggagtggcaaaggagtgacatagattctgtgaagttccttggttattgatagtcttagtgtgttggctttcttgaacactggttatagcagtgatgaactggtcacatggacagattcaggagcccctggttagccagagcggtgtaggcaatggtgatagctgagatgcacagccttctccttcttggacacggtgttattctaccaagaaatacagtaatggactgtgtcggttgtcctgcagccaggaggtggtgcttgccaaaaagcatcagctgtggtggcaaccgtggcagttttgcttgccttatgtttcctgttggaggggagtatctctgatttctcaggcaatgggcagggccaagtagctcccaagagattttgatctttttgttgagctaccagggccgatggcagggcaaagccaggtgggagctgggttgggcaggtttgcattctgagtctctgtgtgtagggcaaacagcagcccctgtgggtttttggggacaggggcaggtttcaaaccgctgggttgatgttccagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttggtaaggcggtaatcagcactcaccactaacagtagtcataagattttcccacagagaaagcaaccatggcttttaggccttgcccttctctgtctgctgcaaagccaggcacctggcatctgcacccagggctcctgcacccatgggcctacactcatgactcttgcactcatggcacgcttttcactctccccatcctggccctggccaagggagttcgtgtccacccaaagttatattattaaatccctttgggagcctctttctacctgtggccaccacttgaaatgtttggctctcttcctcagcaccctttgtgaggaacagtaaagaatagctaccctcagttcacactgggatctaggagtccatgcaagggtcttcccactgctgatcctacttttatactccatgaccctccccaactctgtttctgcacagggtggggttagggccttcccccgtgtattgagctttcagggtccccagtgggagtgtatatcctagaggcaaactctccccttctcatactctatgtactcacagcctttgcctgactcacactgtaggctgcagcctctagcatccttcaaagtgtccataaattcctccggttttcctgttcagttcctgtgtcacttcttgaaaaaaattcacagtgtgaatctctgcacactattttgtccttccaagtgtgagagatatgctagcaatgccttcaatccaccatcttggggggaaaaaactctaatttgcttttaaattagattttgtattaagacttttaataatcaaaataatcactgaatgctgaactgaatttttaaaatattaaaaatagcaatagttcagtctgttaatcactaacctaacatacacatttattaaaaccctatttccaaagttgaactgtaattaagtttgtatggagagattcacataaaagttaccccattacttctttagtagtttttttgttgttgttgtttgtttttgtttttgagatggagtcttgctctgttgcccaggctggagtgcagtggcaccaacttggctcattgcaacttctgccttgctggttaagtgattctcatgcctctgcctcccaagtggctgggattacaggtgcccaccactacacctggctaatttttgtatttttagtagagatggggtttcaccatgttggccaggctggtctcaaactcctggcctcaagtgatccacccgcctcggcctcccagagtgctgggattacaggcgtgagcgaccactcctagaccctttagtagttttatagtttgggctcttatgtttaagtctttaattaattaagatttttttaatatggtgagagatagggaatctagtgtcattcttctggatatgaacatctgttttcttcctggaccatttatcaaagatggtatctttcctcaatgtatgtttttggagcatttgttgaaaatgttccaatagtcacaaataaacattctattaaaaaattttttgaataatggttagcatctacattacagttaatagctaggtcttactgttaataattgactaatgaactgttatactaatattcactttcaaaaccatcataaaaaaacagttttatgaaatagatacttttagaattaatggttaatgaaaacattcatttttttctataaagttatttttgtgtaatattttttcttttttattgatacgtaataatagtacatatttaagaggtgcatgtgtgattttactacaagcatacaatgtataatgatgatcaattaaggtaattaggatattcatcacctcaaacatttatctttttgagtgttgagagcatttcaaatctttacttccagctattttgatatatacaataaactattgcttatgtccccatccctaccctcatttatgcactttttccagcctctggtacctatcgttttaccctccctacatgagataaactttttaacacccacatatgagtgacaacatgcaatatttgtctttttgtgcctggcttattttacttaacatagtccatcagttccatccatgatggtacaaatgacagagtattatatttttatggctgaaaagccttttatttataaagtttttatctgttaatctgttcacaaacacttgtattggttctatatcctggttattgtgaacagtgctgcaataaacatgggaatgcaggtatctacttaatatactgatttcctttcctctagataaatacccagcagtggcattgtggggtcatatggtagttctatttttagatttttaaaaatgaacctccagactgtttttctataatagctgtactaatatatatttccaccaacagtatataattctcttttctccatattcttgctatcatttgtgtgtgtgtgtgtgtgtgtgtgtgtgtgtgtgtgtattttgataatagccatgctaattgggtcgagataatatcttactgtgattttgatttacatttccctgatgattagtgatgttggcatgttttccatattcctattgaaaacttgtatgtctacacttgagaaatatatattaatattatttgcccagtttttagggagattatttgattattctgttgttgcattgagttcctcatatattctgcatattagtcccgatggatgaatagttcacaaatattttttccagttctacaggttgtacctttactatgttgaacatttcttttactgtgtagaagctttatagtttaatatagtcccatttgtctatttttttgttttgttgtatgttttgaagtcttagtcataaaatatttgcattgactaatgttttgaagaatttctcctatgttcttgtttagtagttttatggtttggggttatatttaagtctttcatcaattaagtttttttaatatgatgcaagatagggaatctagtgtcattcttctgcatacggatacctgttttctccaggaatatttatcaaaaatggtgtctttcctcaatatatgtttttgaaacatttgttgaaaattggttggctgtaaatacaataatctatttccaggttttttattctgccctgttggttaacgtgtctgcttttgtgccaatatattgctgttttggttaccatagcttagaagtatatcttgaactcaggtagtgtgatacctccagctttgtcttttttgcttaggattgctttggctatttgaggtttttacggttacaatttttcttttaatttctgtaaagactatcatttgtattattttttttgagacagactctacctctgttgcccaggctggagtacagtggcacaatcttggctcactgcaacctccacccttcaggttcaagcaattctgctgcctcagcctctcaagtagctgggattacaggttcacatcaccatatctcgctaaattttttgtatttctagtagagacagggtttcaccatgttggccaggctggtcttgaactcctgacctcaggttaactgcccacctcagcctccaaaagtgctgggattacaggcatgagccaccatgcccagattgtattttgataggaattgcattcaatctgcagattgctttcaatagtatggtcattttaacaatatcaattttttcaatcgttgagcatggaatatttttccatttgttttcatcctcttcaatttattttatcagtgctttgtagttttcctaatagagcaattttcatctacttgtttaaatttattcctagttatttttatagctcttgtaaatgatattgttttcttatattcttttttttatctagtttgttattggtgtatagaaatgctactgttttatatgttgattttgtattctgcaagtttactgaatttgcttatcacggctaagaggtttttggtggaatctttaggattttctatataaagactgtgttatctgcaaaaagagacaatttgtcttcctcttagattggagtgtgttttctcttctttttcttgactaattgctctggatatgatatcaagttctatgttgaataagagaggtgacagtgggtatccttgtcttgttccagcaggtttccaccttttctcaatttcaccttttctcaattcagtataatgttagatgtggtttgtcatatgtggtctctattatgttgaaatatgttccttctatgcctaattagttgacagtttttatcatgaaaggatgttcaattttatcaaatgttttcctgaatctattgagatgatcatataatttgtgttcttctttttttttcttttttttgagagggagtctcactctgtcacccagactggagtgcagtggcacaatctcggctcactgcaacctccacctcccaggttcaagagattctcctgcctcagcctcctgaatagctgggacaccaggtgtgcacccccatgcttggctgatttttgtatttttagtagagatggggttttaacatgttggccaggctggtcttgaactcctgacctcatgatccactgcctcggcctcctgaagtgctggaatttcaggcatgagccaccacaccgggctgatttgtgttcttctttctgttaatgtgatttatcaattctattgattagtatatgttagatcatttttacatccctgagataaatcctacataatcacagtgtaccacctttttcatgtattattggattcagtttgagtactttattgataatttttgcatctatatacatcagagatattagcctgtaattttcttttttgttgaattcttgtctggttttgtaatcaggtttagctggccctatacaatgacataggaagaattccctcctcttcagtttttttaaatagtctgagaagaatagatgttagttcttctgtataggtttggtagaattcagcagtaaagccattcagttctgagcatttctgagttgggaggtttttttcagctattattgcttttgattctatctctcttatagctcaaataatatctgtttttcctatcagggtgctgtggtgttggtgaatataccttcacaaatgttatatactcttgaaaattgattcctttattattatataatgatgtcctttgtctttttttatgtttttgacttaaagtttattttgtgtgatgtaagtgaagctactcctgcacagtttttgtttccctttgtgtggaatattcttttctgttccctcactttcaatctatgtgtgtcttcacaggtaaagcaagtttcttgtcaacagcatatagttgggttttgtattttttatccattcagccagtacatactttttaagtaaggaatttaaaccttttacgttctggaatgttattgataggtgacaacttactcctgtcattttgtcaattattttctaatgttattgtatattgtttctttcattctcttattttttacatttacaatttgattatttttgtagcaacaacatttgatagctttctctttctcattcgtgtatatactctaccagtgaacttagtacttttgtgtcttttcatgagggtagatatcttttcactcccagattttgcattttcttaagcatttcttaagcatcgtaggatcaacctattggtgacaaattcccttggtttttcttgcctgagaaaggctttatctctccatcattttggaagaatagctttgcacagtttattattctttactgccatgttttgttctgttttgttttgttttgttttgtattgttagtactttgaatatcccattctttcctggcttataaggtttctgctgaaaaattttgagaaattagctgttgatctgatggggatttccttatatttgatgatgttttttcttgctattttgatggttttactctaccttaaacatgaccttttagaattgaatctacttgggaatatttgttgcatttcctgtatctgggtgaattcatgtatatggatgcttcttataaatggatgcttcttataaatggatgtatatattttgttcaagacttgagaaattttaacctatcattttgttacataagttttccatctctttttctccacaattcccaaaatttgaatatttggttactttatggtgtcccatatgtcacataagctttcttcattctttttaagtccttttttcttcttttgtctatgacatttcaaaagacctgtcttcaagtcagaaattctttattctgcttgatgaagtctattgctgaagattttgattgtatttttatatcactgattgaattcttcacttcaggatttctgtttgtcttttttatcatatctagcaatttatcattcagattataaattattttctaatttcccaattgtttatctgtgttatcttgtatctggctgagttcttcaatattattattttgaattcctttttagatattttatagatttttcttttttgtgatttcctactagagaattattattttccttcggtggcattatgtttccttgctttttcatgtttcttgcatctttaaattgacatatcagcacatcctgggtgacagtcacttacttcagttacatggattggcttttacgtggaaacactttttttcaattgctgagcagttctgctttttaaagcagcaactgagctgtaaagcagacccatccttagacaggaaactgaatctacgtgggaggaagacacagtggtgggcaatctggaagctagaaggaaggacagtcagagtgagtattgtaaagccagaagcatggcttatctaacaccccgctgggatatctaagagagcccccttctcaggtttttttctgtctcaaaagaaactgaggcatgggtagtgataaaatcacaagtaatctcaccctaccaaaacccagtctcctcattaaatgctacagaagtctggaaggagttctcattatacaggcctatgacactctcactgtccaacagtcttcatttctggttttgttcaagattatatccctctcacacacaaagaaagcatttatcatgagagaattttggtactttatgaagttgtctgcctttaattatttatattgtcttctttctcttagtatttttgttttttttttctttagggaagggatagaggggactgtttttgatattgctattcttcttctgtcatctaggtaaagcttcctttgaaaatgccaacctgtttgaacactcctcaggagacatgatgaaagatgttctctataatttatctgtatattcccagtttccaaatatggcaataacagcaagaataaacagacggatatctcaataagatgaaaaattagcaggaactgatgaagggacactcttatcgctgttgctttccattatgattgttgaactcaaacagctcttcctgtgtctcaggcagaatcaattatagatagaaaattaacttacaaatatctttatttacttgattaggaaaaggatactgagtagtcagcaagtaatagttaaaaagaaatcataaaattggaatcacaagatctgtgttccagggcttcctttgactttaaaaagtggattacccttaactgagtcacatacttctttaagatttttttatatcatcatctgtacaacaggaacagcaaactagaagatctctgagatccccttaaattttaaattgtttcaaattataccctaagatatctgagcaagaaagatttaaagagcaaaattttacctcaacagagatgagagtttgttagtgtaattgagggggtcaaaacaaaataatatattgttaaatagtgggtgaagacttagagtgatagaagtcttttccataaaaaaatttagtttttaataaatcctttcactgacatcaacacagtaataaaggagaagcacctataacacggcttcaatagcaatttttacagcaatgtgtaaaacatgccatcagagaagaattcctgttccttaaatttccacgttacccagcatctgccatagctaacaggaaatgaaatagaataaactatggaaagatattgaataaagactccttaactatggagtttgataatttgaagtaaggaaataagaattctctgcttttagaataagaaacataattccaacaaatgaaaaatctactgtttctccctgtggaatgtgaacaatctagcataggtttctgaagggaacctggcgctatggtagaaaatgatcagaactgtattgatttacatatgtttcttactcttataggcatataggagccttgcatgaccacactttaaacaaatattttcacagtatttattattgatagcatacatgcattaaattgttttttataaactctaataattaacttcataaaccgtcttaaataaatgtttttcttatttgtataatgaccttagtttaaaatgtaacctttcagatattttcagaattacgtacataaagagggtgaacctatcttagaaatacaatagtttccgctttccagaacaataagactaatgaaaaaccgctttaaataatgttgcttgagggatggtttctctctaaacaccagaatgtgtagaaaatgtttacacggcaaaataaataacctgttaagaggcttaaaattttagttagaacaataatatacacagtcaacataaaagccttgtttacatggttgtttgggaatattttaaaacaaaaacagtttgcttcatattcagatctcccatggctcccaaagaagactttagttagagaaaaagagttgtttaaataaagagaattcatttatttctgttatagtgtaataataataactagtcatttatagttattcatacatttgtataatttgaacaaaagccatcagcctgaggctttctttctcatttctgcaaataaagatatagagtgtttgaggaattcatgtagtttgcaaatatttgcttttggagacaaatgatgataattaaataaaatgctgtgtgttttgttgaatgagcaatgtaataacatttaggcatgtaaacttaaagaataaagctttccattttgaaaagatcttattttgcatatttaatgaaagtcttgattatttgttatatactgtcatcagtttgtattcaagtaaaggtaattaatcatacttcttaactaaaaaattattaacaactgttatgcatggtatacctgaccatatctctcataaataaatatacaggtaggataatgaggttcaaaatatagtgtaacatacaatttggcttcatagaacataaaacataccattggatgttgatgggtatgtttctatatgcatcaattttcattctagagaaaagatcataggcttactctttagatatacctgaagttgcatataagaataatcaagtgaatttgcgatgtgaatttagataatttatacaggctattaaaggctgttgtgttctatctgtaaaggtataaaatgcaatacatcttaattcattattgtaaagactaaataactaattctcattcctcacttctcttttttatttatgccttctattcatctttcagcatgttctcctcctcttcactgctctttcacattcccattaactattgcatattattctccatatttttgtagcagaacctaaaatatctttaaccaaaaaataatcttatttcccttttattgttgagcactccgcttaactacaattctgagcctccctttgcattatgtgcaggcttttaactgagttggggtcaatgaacagtgtctaggagtaaaaaatggtacttcctgatctgtctcatataaggcttgatgtcattcatcttgtctttccccactcactaaatgtagaagactcagggacatggaaaagggtaaagccactgtcataaggtaaaagtcacctgagtccctaaacatcttgtgaatattggcatttaattgttatgtaactaaacaaagttttttttgtataaagctactgagattgagatattttataggagtttatgtcactttaattcatgtagaattggtatcttgaagtgaatgttgtgaaaatataagcatagacttagctgtgaggtgactggtggaagaataaactactatgggaagcagaaaatctgcagagccatacaacgttgtgataaaacatttgacagaaatgtcacctgcattatatggacaccatgtgcctgtagctctagaagaggttggaaaacaagatatgagtttttagtggtgatttttaaaactggccttccttagtatgctatatatgcttcgcatgtatgctatgcctacagaaggaagagataatctccagcaaagagtgaacaatgtgcaaataaaaaaaaatgaaatgacagagagagtccagaaatctgaaatattggattatggaaacaccaacagttttagaccttaaagagtatgactaagaaaggttttaaataatgcaatcacatcaagactcagcaaaattgaatagcaacttcactagtgggaaacaggaatgaaaggaagaaggaagagatgatgacaaaagtagaaaacaaataacaaaatggcagaagtaagtcattactgatcaataataacattgaatataaatgtgctaaactcttcaatcaaaaaacatacactggctgaatgaatgggaaaataagactcattgatctgttgcctacaagaaacacatgtcacctataaagacacacatagactgaaaggaaagggatgaaaaagcatatttcatgccaatgtaaaccaaaaaggagcaagagttgtgatacttatatcaggcaaaatagatttcaagactaaaactgcaagagacaaagagggtcactatataatgataaagggatgaattcagcaaaaggagataccagttttaaatatatatgtaccccaacatttggagaattgagatatataaagcaaatattatagctaaagagagagatagacctcaatacaataatagctggagacttcaacaccccactttcagcattggacagatctactgaacagaaaatcaacaaggaaatatcaggcataatttgtactagagaccaaatggatctaatagatatttaaagaacatttcatccaatggttgcagaatacacatttttctcctcagcatattgattattctcaaggataggccatgtgttaggtcacaaaacaactcttaaatatttcaaaacaaattgaaataatatcaagcacattttctgaccacaaaggaataaaactagataataacaagaggaatttgaaaactacatgaatacatgaaaagtaaaaattgtgcccctgaataaccagtggatcaatgaagaaattaagagaaaaattagaagatttcttgagacaaatgataatgaaaacacaacatacgaaaacctatgggacacagcaaaagcagtactaagatgaaagctgatagctctaaatgcctacatcaaaaaagagaaaaaacttcaaatatacaatctaatgacgcatcttaaagaactagaaaagcaagagcaaatcaaacccaaaactggctgaagaaaataaataataaaaaatagagaagaaataagtgaaactgaaataaaaaatagaacaaaagtcaacaaaacaaaaagtagtctttttaaaaagttaaagtaagtggacaaatatttagccagactaatagaaaaagagagaagatgcaagtaagattagaagtgaaaatggagacattacaactggtatttcagaaatttaaaggatcattagcagctactatgagcaactacataccaacaaattggaaaatctagatacaataaatgaattcctagacacatacaatctaccaagattgaataatgaagaaatccaaaatctgaacagactagtaataaataacaagatcaaagccataacaaaaagtctcccagtaaacaaaagcccaagacctgatggcttcactgctgaattctgccaaacatgtaaagaagaaataatatcaatcctactcaaactattctagaaaataaaggaggagagaatacttccaaactcattcttcgaggccaatattcccctaatgccaaaactggacaacaacacattaataaaaaataaaacctataggtcagtatctcttataaatattgatgcaaagatcttcaacaaaatactagaaacccaaattcaacaatacattagaaagatcatccttcatgaccaagtagtatttatctctgggatgcaagtatgattcaacatatgcaagtcaatcaatgtaatacatcaatagaatgaaggataaaaagcatctgatcatttcaattagtactgaaaaaacattttataaaattcaatatccctttatgttaagaccctcaaaaaactgggaatagaaagaacatacctcaacataataaaagcaacatatgacagacacacatctagtgtcatacggaatggggaaaaactgaaatcctttcctataggatctagaacatgacaaggatgcccactgtcaccagtgttatttaacaaagtactggaagtctttgctagagtgatcaaacaagagaaagatataaaaggcatccgaattgaattgaaagaagtcaaatttttcttatttgcttaggatacagtcttacatttggaaaaacctaaggactccagaagaacactactagaactgatcaacaaattcagtagagttacaggaaacaaaaccaacatacaaaaatcagtagcatttccatatactaacagtgaaaaataaaaaaaattaaaaatagtcccattatactgaccaaaaataaaattaaatgcctacgaattaatttaaccaaagaagtaaaagatctttacaattaaaactataagacactaataaatgtaactgaagaggaaaccaaaaaatggaaaaatatttcatgttcattgattggaagaatcaatattgttaaaatgtccatactactgaaccaacatataggtttaatgctcaaaataccaatggtattcttcatagaaatagaaaatacaattagaaaatttatatggaaccacaaaagacccactaccctaagcaaatagaacaaaactgagggaatcacattacctgacttcaaaaattttgctacacaactatagtaacaaaaatagcatggtactggcataaaaagagacacatagaccaaaggatgaatgttgagagcccagaaataaatctacacaccaacggtgaactcattttcaataaaggtaccaagaacatacactggagggaagacagtctcttcaataaatggtgctgggaaaactggatatctatatgcagaagaatgaaactagatccttccctctcaacatataaattaactcaaaatggattaaggacttaaatctaaggccccaaactatgacattggaaaaatcttcagaacattggtctgggcaatttgtagtgcactgggagtgtcataataccttgttttttcatatttcctgtattattatgctgattttttgcatctggagaaatagttgcttctatttatttttgaatttattttgttggggtggggctttttccccctgagaatacaacaatgatgtattttgaatagggccgtatggctttgcttctgagtacattcattgttaaagactgcttaagttttttggttataaatagccttaatatagtggcttcctcaaatgctggtagtagtagcaagagagcttgtgcacagcaaccaaaataacagagtaaacaacaacctacagagtggaaaaaagtatttacaaactatgcacatgacagaagactaatatccaaaatttacaaggaactcaaacaactcaacagcaataacaaaataatcccattataaagtgagcaagtgacatgaatagacatttttcaaaagaagacatacaaatggccaacaagcatataaacaaacattcaacatcatttctcttatcattagagatacgcaaatttaaaccacaatgagatataattttaccctagtcagaaagactattattaaaaagtaaaaaaataatagatgtttgtgaggatgtgaaggcaaaagaatgcttagtaaattaatacaacctgtttggagaacagaatggagatttctcaaagaactaaaaatagaagtaccatttgatccggcaatcccactactgggtatctacccaaaggaaaagaaaatattatatcaaaaatacacctgcatttgtatgttcattgcagcactattcacaatagcaaaaatatggaatcaatctctatccattgatagatgaatgaataaataaaatggcgtgtatatagataaaatgctatgtgtagatacacacatgcacacatacatgtatgtgtatatatgtacatatatacacatatgcaaacatatatataacatggaatactattcagccataaaaaaagaatgaaataaatgaaatcatgtattttgcagcaacatagatgaaactggggacattatcttaagcggaacaactcagaaacagaaaatcaaataatgcatgttctcatttacaagcagaagctaaataatgtgtatatacggacatgaagtgtgtaaaaagagacactggagactcagaagggtggtgaaggatgagaaattacttaatgggaaaaaatgtacattatttggttaatggttacactaaaagcccagacgtcactattacacattatatccatgtaaataaactgcagtgtaccacttaaatttctacaaaataaaattaggaatctttgtttataacagaatgaaaaaaataagccactgattgggaaaagctatttgcaatgcacatacagtaagaggcttttaatagactaaataataaaccttcacaaatatataaaaaacagaaaattcaatagataaatgggcaaaagctcacagattcttcaaaattaaataatactaaaatgacaaataaacatatatagattctccacttcattattattcagagaaatgcaaattataaccatagtgacctatcattatagaactgttaagtttaaaaagactaataatggaacagctggtgaaaatgtagaccaagagaaacttatggatacttcaagacatcgtgttgtatatgataaatacatacaatattatgtgtcaaatttaaaaattaaaaattaaaaaataccatctgagggatgtgagatattgaattcttaatacaatttaaattttcttaatgttgattcagattataatgatgaagataattttaacagtgatttggtgaatgataaaaaatagctagctgttttacaaacggactacttaaatgatgctataatgtaaaagcaaattacacaaagtgagatttaattaaggaggatataataatacctcacattttttgattttttaaaatagaattgtgtttagcagttgaattgtcttatttaatattcataaaagcctgggcaccagacactatcatcaaacataatttagaaataagaaaacccaccaggcgcggtggctcacacctgtaatcccagcactttgggaggccaaggcaggtggatcacaagatcaggagatcgagaccatcctggctaacatggtgaaacccgtttctcctaaaaatacaaaaaattagccaggcgtggtggtgcgcgcctgtaatcccagctactcgagaggctgaggcaggagaatcgtttgtacctgggaggaggaggttgcagtgagctgagatcgtgccactgcacttcaggttgggcagcaagagtgaaactccgccaacccatcccaaaaaaagaaataaggaaatcaagtattacagagcacaagcaacttttcctaatgttaggtctaggatttggaagtaagcagtgtcatccagaatttgtgttcttgctatatagaggaagtcaaaacaattacctaaacaaaaactgatattcaagattttcaaattaggcaaagttttagtaacttgtattgataaagaaaaactgcctagaatatcaataaagatttatgaattttcaggattaaaaggaacctaagatgccattctctagctgaacactatttcatcttcctttggacatcattgataattggctcttcattcatgtgaggctccacacattagaaaaatattcctttagtagagctgaaatttgtgttatgttttggtttgttttagcttccaatgactgaccctaactctgtccctgattaatttgcagtctaatttatattatactgggtcgttctgaaacaattagataaacctatcaagtcatacataatttcttctctaaatatttcctgttgtttcatttttttttccacatggaatgattcctgatacctttcctcagggtatgctcatttgtcaacatcccttattgataaaattggaaaatttcttaggataattgcatatataaagagataacttatgtccaatatctgggacatgataaaatctctcaaatttccttaagaattcaaagctgtgatagtctcatttgtgtgtggagtagtcccctcttgaaaattacaaactttatttgtttttaatttatgaatgtttctttatttttcctttgggacaaagaaagaaaaaagtatgcatgagcactatctttttcaatataagattatttatttaggttatatttctatgaatggaattgatggataagaaatcgtctttttggatagagactaagttgctgtaatgaagaaaatcccaaaatacaatcaatggcttaaatatgatagaagttcatttctccatcaggaaacagtataattaacagggtaaccctgcctcatgagaacttctagggagggtggttttctccatcttgttctctatcaactaataagacattgcccttatcttcatgaccaaaattatatcattgcaaaatctgctttccagtctaaagaaagcatcagtccagaacaagagatttcacttttattataaattgtaactgacctggaagctgcacacgtaaattttgttctcattcccttgaagagaatggattcaaacaagacaggttggttgtaaggaggctgaggagtgtggtctccagctgtgaagccatatgcattgcttcagctcttttcctgtgaaaagagaacaaatcaaaatttagtgtgtcaaccatctctcctacagagactacattcttttgtttccatgaatctcgaaataattttcaagattctttacaaatgattattatctttaaaatattagtaaccatattaatctgtagtgtaaaaatcaaatttttaagacaagaaattaataataaaatcaatatcgtgtggtaagaaatataattgactcattaagtaaacatctcaagttacagaaacagaagggtgtgagcatattagaaatgtgtatgttgaccacaagcatttgtgctgtcacaggctttagtgagtataatttacttaaagactagagagcaaaatttatcttgcaggttttttcaatgtggtcagttaaggcagcttctcttgtaccaacttctctgtggtacatcatatgttgctctgaacaccacattctcaaacatctgcttaaagctgtcctctagtaatttagagctcactctaaatagtcacattatattaaaataagtaattcacatttctcatgtatgctggtaatttttctagtaaatattgcttatattgaagaatcatttactaatctttttgctgttacatgaaaaagtgtttgcacaaacaaggtaaataagtggaaaccaaaatttgcatgtttagtgatttcagaggatatcaaaataaataataatgcatattgataaggtaaccaaaatcattcggcattccttcaattccaatcatagacaaagaaagcttatgctattcatttgtgacattctggattctctccacctttcatgtgcctattcatttttaagttttgctccaggatagccctattgaactgtacaatttctgaggaaagaaagcaatacatgcagcatttcaaatatatccttgctgttaaacccgagatggctagttcgcaactactcactggaacctgacctaggagagttctgtacagcatgcagccaatgggaaggaaaagtctccaccctccaggaccttaagctttagttagtgaagataaaatatactctaagaagcaactatttaccaagtctaaatcttaaagtaagccctgaatcattcatattttagtcccacatccagttaatcacgaagtcttatattctaacttctcatcttcacagccactagtttataatatttccaacagtgctgtcattcgtcccaccagctctggtcttatctcactgtaatactcccttgcagagatttctttcactgtgcaccttaactttgaaaggtatagataaaaaaaataaattattacatacgagtaacagaaaacaacttagataatgagtcagtccacatgcacataacccatctctgaattagtcaatataatatgctcaattacccactttctccacattcttatgtggcatacttactctatgctcttcaaaaaagatttatattttcagggttgaaatatgattatgtcatctccattctcagttagaatattttaaatataccctcaaaattcctaggtaagtccaaattcccttatatggttcttgaagttctggaagtggtgttaccttgctctctggatttagctgtagttattactctccatgtgtgctaaagtatgccatttaaaactatttgtagttatctaactttatattctttcttgccttggggctttggcacatgctgtttcttgcctaaatgtacccacccctttcatgttgcttgtaaattcctccttgtcttccatgaccctagtctaagaactaaagtatctttcttaaatgctcccataaaaccatgtactcatcttatcataacactgatagtactctgttgacattgtcaactccctgtttcagatgtctatgaaacctcaactccctgattacagagactatatttttctcctttctatactgagtggctagtacagtatctcatgcatagaaaatatacgataattatttgttaaattgaaattcacaatttgtggcatagattagatgcatttgtgcctaactaaaaaaaggaggaggtttctctttactaggcattatgctggatattaatgatttcaaagttaatgtgctaaaattcctgtcattccagaacacatcttagtttgttaatttctttctcttccttttttttttttataagtggtcacatttgttattattttttagaaaatacttgggataaccccaaatttgaatccatatctgcattgcaaatatggggtagagttaactggggaaaacttgaattttctcttgaaacaaaattcttatgtatctagtataaataaattgggctgacctaccaaaaagaatacatagcatggaagggaatcaataaacaattgtttgaaataaaaatgactgagtagatttgctggaataaagataatccaagggccaggtaaaagatatgaagtctatggattataagtgggatctgagtcataaaaagagatttggagaactgaagatgttgagtgactgagttttgatcaagtatataatgggttatccaagtagataagcatataatagataatttttctacaagatttataatgagcaattttaaaacatctgggctagagaaatataaattgagaaggttgaaattatagtgaaattttgaaaatacattagaacatctccaacaatgatagaacatttcagagtctaataatttcagtccttaaaattttggttaaatgttcaagctgggatgaataatttggcctttatagtctcgtttaaaagcttcaggagctgcggtggctcaggccagttgtcctggagcataaggaggcgaggctacacattcaaggccaacctgggcaacataaaaacctctcatccattaaaagcttcaaaaattgccacaatctagaacactgtaagattgttatattttctgcatgagagaattttaaaatattatttctgaaatattgtctttatatatttgagagtgatctaaagagttaataacctccaaatctgcatcctcactgaagataaaataaaatgaaatgtgcctttactgaagcagaggagattcgggaaaaattcaatcaaaaccttcccaagttagggatttctactcacatttacttagaacttcaaggaggaaagtttttgaaaatgatataggccttccaatatatagttggaacctttttatgattctattatttaaaaaaatttgctattttaaaaaatgtttgtgggaacatactagatgtatatatttatgaggtacatgagatatttttatacaggcatgtaatgtgaaataagcacatcatggagaatggggtacccatcccctcatgcttttatcctttgagttacaaacaatctaattacattctttaagttatttaaaaatatacaattaagttattgtcactgtagttttttgagaagcctccaaactgctgtccatagtggttgtactaagttacattttcaccagcagtgtacaagagttatcttttctccacaaccttgcaagcatttgttacggcctggcttttggatacaaatcattttaactggggtgagatgatatctcattggagttttgatttgcatttctctgatgattaataatgttgaacaccttttgatactcttgtttgccatttctatttcttcttttgagaaatgtctatgcaaatcttttgcataattttttattagattattagattttttcctataggcttatttgagctccttatatattccggttattcatccttgtcagatgggtagttttcaaacatgttctcacgttctgtggggtgtctcttcactttgttgattgtattctttgctattaagaagctttttaaatcgatgtgattccatttgtccatttttgctttggttgcctatgcttgtagggtattgctcaagaaattttttcccagaccaatggcttggagtttccccaaggttttctggtagtagtttcatagttcgaggtcttggatttaagtctttagttcatctttatttgatttttgtgtatggtgagagccaaatatctagtttcattcttttgcatatagatatccagttttcccagcatcatttattgaagtcttttgccccattgtatgtttctgacatccttgtcaaaagtgagtttactgtgggggtgtggatttgattttgtgttctctattcttttccattggtctatgtgtctgtttttatgccagtaccatgctattcttgttactaaagttgtgtagtaaaatttgaaatcaggtaatgtgattcctacagttttgttctatttgcttaaagtagctttggttattctgggtcttttgtggttccatataaattttaggattgttttttctatttctatgaagaatgtcattgttattttgatagggattgcattaaacctatatattgctttgagtagtatgaatattttaacaatattgattctatcaatccatgaacatgaaatatttttccattattttgtttcctgttcaatttctttcattagtgttgtatagttttcattataaaattatttcactactttggttaaattaattcctaggtatttaattttatttctggctattataaatgggactatgtttttatacttcatgctgttgatatgatagatcatgttgattgatttgtgtatgttgaaccatccttgcatcacagggataaataccacttggtcacgatgaatgatctttctaatgtattgctgaatttggcttactagtattttgttgagcatttttgcatcaatatttatcagaggtagttttctttttttgatacagttttgccaggttttggtatcagggtaataacgttcctcggagaatgaatttgggagcactctctcctcttctattttttggaatggtttgagtagaatttatattagttcttcaaatgtttggtagaattcagcagaattcagatgaagccatctggtcctaggcttttctttatggggagggattttattatggcttagatctcattacttgtcatcagtctgttcagggtttggatttcttcctgtttcaatcttggtaggttgtgtatgtctaggaattcatttatttcttctagattttccagcttattggtatataggtgctcatagtagccactaatgatccttttaatttctgcagtatcagtagtgatgtctccattttcatttctgattttattaatttgtatcttctctcttttttcttagtctggctaaagatttgtcaatttaatttaacttttcaaataacctactttttgtttaattgactttggaattttttttcaattctatttatttctgctacaatatttatcatttattttcttctactaattttgggtttgatttgctcttgcttttctaattctttaagatgcattgttagactatatatttgaggtttttttctctttgttgatgtaggcacttaatagctatcggacttccatcttagcatcgcttttgctgtatcccagaggttttggtatgttgtgttccatcataatttgttttaagaaatatttcaattttcttcttagtttcttcactgacccactggtcattcaggagcatattatttaatttttgtatatttgtatagttttcaaaattcatgttgttattaatttctagttttattccattgtggtcagagaagatacttaatatcatttcagttttttgaatgttttaatccttttttttgtgaacatattgtttatacttgagaataatccaggtgctgagaagaatgtgtattctgcagctcttggatgcaatgttctgtaaatatctattagattcatttggtctatagtgaagattacatctgatgtttctttgttgattttctgtctggaagatctgtccaagatgctgaaaatagggtgtgaagtctccagctattattgtattggggcctatctccttctttagctctgataatatttgctttatacatctgaatgctccagtgttgagcacttatatatttaaaactgttatatcctcttgataaattgatttcttatcattacatagttaccttctttgttctcttacagcttttgtcttgaaatttattttgtctgatgtaagtacagcaacttctgcttttttgttttccattggcatggaatatctttttccatctctttattttctatgtatgtatttgtaggtgaaatgtgtttcttatagacagattaatgagacttgttttttcatccattcagttactctatatcttttgattggagattttagtccaactacctcaatgttattactgaaaagtaaggacttactcctgccattttattattctttttctggttgttctgtggtcctctcttctttctctctttcctgtcttcctctagtgaaggtgatttcctttttgtacttggatattgatatatttctgtaggtttcagaagttgcctgttattattcctttgaataaatttgctccctctatttatttatctacctcttctttaaggccaataattcttagattttcccttatgaaactattttctaaatcctgtaggcatgcttcattttgttattcttttttcttttgccttttctgactaggtattttcaaatagcctgtcttcaagctcactagttcttgcttctgcttaattctgctgttaaaggaacttgatgcattcttcattatgccaactgcattttttaactccagaatttctgcttgattctctttaattattttaatctgtttgtctgatagaattttgaatttcatctctgtgttatcatgaattttctttgagtttcctcaacctacctattttgaattctctgtctgaaagatcacatatctctgtttctccaggatttgtccctggaaacttatttagtgttcatttggtgagattaagttttcctggatggtgttgatgctagcagatgttcttcagtgtctgggcattgaaggattaggtatttattgtagtcttcactgtctgggcttatttgtactcatccttcttgggaaggttttccagatatttgaaaggacttgggtgttgtgatctaagctgtatctgctttaggggggaacccacatccagtaactctgtggttcttgcagactcataaaggcaaccccttgatggtcttgaatgagatctgagagaattctctggattaccaggcaaagactcttgccttcttcctttcttccaaatatatggagtccctgcctctgctctagccacctaatgctgaggactggagtgacacaagcccccttgtggccatcattaatgtaatttcactgggccagatctgaagctagcacagcactgagtctggctgaaggcttgctgtagccactccctgattactgcctatgtttcctgaaagcacttgggctctctaatcagctggtggaaaaaccaaccaggcttatgtccttccattcagggtagcaaggtcccccagacccccagtgggtccagaggtatcatcctggagtctgcccttttttaaattaaaaataagcaatcaagaacagcaacaacaaaaaattgccagagtaaacatcatctttatcttaagcaatgtcagagtggaacttaaaacttagaaactggaacttagaatgccttattgaaagaagaacacacatatggacttaaaatggtaccaacagagagaagaccaggaaaaaaaaattaagttcataaactactctttgcattttgcttttatttaagaattattccttgcttctttcaataaattttgattgtgtgagttttcaattctccagaaattgaaaataacataatgtgctcactattcatgattgcataataaaaccacttgggtattaaaaaaataataattccttagctagaggttactgaatgacaatagaaaaaagaagaaagaatctacataagtggagacagttctcactctaagctgctgaatatgctttctgtttaactaagtaaaaagaagtaatcaaaaaacaatttccacaattttttatgaccatattcacctacctgcctctgtatgtacatactgtgttctctctcttgttctgtagatgagccatccacatggcaagcaaagggcagtctctctactatgtcccagatctcattcattcttgcctagacaagagcaatttttctggaactctctcttttctctcttgcattcttttttttctcatgagcatattaaaatgctgctatttcactctcatttgaaagtaaatatagacatacacgtatgtgtatgcatatatgtgtgcatgtgacttcaccataccctccagttactgtcccatttttttctttatttgttttacagtaaacttctcagaagagttggctatattcattgatttcagtttctttacacttgaacctgtttctatcaggcctttgccaacactactccactgacgtagctgtagttaaagtcaccagtggcatactctttgctaaatcatgagattgatagtcatttaacctatttgggctatcggcagcatttgcatagctgatcactcccttctcctagatactttctttgcttggcttctaggacacaaattcctctgctttccttctccttcactggtctcttctcattctttttcatttattcctactcatctttcatatcttttggagctcagccctttgagattcattcgtaagtaagaacaatctatctcactgctttaatgttcatctagatgctcataacttctaatttgtatattcaagtgactgcagaacagagaagtaatctcaaaatatgcacctccaaacccaaatgcccgctattatttactactttgctataaccttttctatttccactccttattcaataagaagcagctcctttccataaggcagctccttatttttgattgtttgggccacaggccttggagtcacatttactctactttttctctcatctgctgtctaatctgttaataaatcctctaggttatgccttcagaatatttccagaacttttatcctctcactgctgcattgttgcctctgttactaaaatatgagttagaccatgcctctgtggtaatcaaagccttcagtggtttacttttaacccagagaaaaagtcggccatgaaaaacatgtacaatctgcctgctcctcctcctcccactccccactcttcacctgtatgatttctcttaattttcctcctatttacactttcacccagagtcttttcattttctcttccatctgtctgaatgttcttctttcagatatttgtctgtcattccccatttcctgcagatttgagtctccttccctgacaggcctccactaaccacataaaatttctaccttccaatttccttttctcttcctcttctacacttttctccttaccatttaccactatctaacaagcaattttaactttattcactttacaaggagttctgactgttttacccactgacatatccctagcactgagcttgtggcacattttaggtacacaataaatatttattgcatattgccatattagaattactgatgaagacccaggaggctgtctttaaaggaagggattttttaaaatgaaaatgttagaaaaggtttcgaagaacaagttgcatttgaattgaggttagattaaatgataggtaatatttgagtgtgtggatgagggaaaggtacctgtggtggtgattactgagtgtgaaaagccaacgatcctcgaaaataagacatctaccaagaacaccgtctttcaatttgggtggaatttggaaggcttgaaaagaagatatgttcaagttactgggaggtaacttgggatgtataagataagcagaaagcctatttgggtcactgaggttaagcaatgaatttcttccctttcttgagcaaacaggcagatccttgatatgttacatttagatatgtgcagtagctttaatatcttcttccagaattcttccagtgacagtctttctgcttatcaagctggctaagggaaatcaaatcaacaaacctcatttcttattgaggtgggccagatacttattcatgcatatttagggaatataaatctcagttccagaatgttcgaactatagactattctgcataagccagaacataattataaacatgtagaaagaaaccactttactccaaaggtgtataatctatacatattttaatagaatttctcttttatacttgggacctaaatttgagtttagaaaaagcaatcagtaaacttacataatgagatttaagaggaaatagtcaagcaggaaattcctctcccgagcaataatttttctacttctcaatctgcacctctttttttcctgcctgactcaaaatagcaaaattctagccttaattctccaggacccctgaaggcattctcttctaatacggtgttttttccttttggttcatcttccatagctgttttgagatcagaggccttggcttccatcaccgcctggaactgacttccctcaccacttttaaaaatcagagataaatagtgaattataaaaatatgagtaaagtcaaaagcaaacactggaaacatgatcaaatacaacaagaacatcaagtgaagtacttcaaatagcacttcaggtctgtatatgtgattagatgagtttatttttagaataatatattcattgaccgggcatgtgttggcctgtcacatgctatagattattagactgacaataacccctatgacttaaggatattattagtgttagctttcaattctacttatataattattaatgattattactgtaattataaataattatttattgagcacctactatatgttaaccacttaatatgaattatcagatgtaatcttcacaacagccctcttagttaggatatattataatttccatttgacaaatgaaggaagtaaggcaaagtgatgttaagttacctgcccaagatcacaaagcaagaggtgtcagacccagaattcgaaggccatctgatcactacagcctgatttcagagtgtagagttttaactattccacaattctgcttactttcagtaatatacaacttcttcagttattaagaagtaaaagtgagagctagctttaatcaggtgcctatacaccagacaccttgcattatttcctttaatctttgcaacagttctacaaattagaattttataggtgagaaagaggttaatttagttgcccaaggtcgttctctccaaaaataaagttctattttccttaaaaacatattggaagattgtcatgaggtcaataatgttcagcaggcatacttctgcaaaatcataaaactcatcttatttacttagtaaaaccatggctaaattaagaaagagataaataaaggtgcattccattatttttcccactttcaaggtccagctcaaatgctgtattttctaggtctagttccttcattaagccttcctcaattccctgatccccaaaaccaactaatcttatatttcaattcaattaaggagaagcaagtctaatggattgggaacagatgtgcatatttttaaactgctgttgcttactgtggaagtcagacctattaaaccctccattttaaaaacctttaccctttacattctgattattttatggtacatattctgcttagtagtagtgttattgtgttgttcttattctgtcttccaaatgataagcagatgataagcaaagacttttatattcattcattcttatatcttctgtagtgtttaatacagtgcctagcatactgtatatggtcaaaaatggttataatattgatgtcagtggataattcaatgatcccacctttgattagcaattttttaatttaataatctttaaatgcctagaattaatagcaccattctctcagcttctatacccaggataatttctggacacttctgatgactttcccatgatctccggaaataataaaagataagctttacagatgaggtaacagatttgcaaaatattaaatatgccattacctgaagagggcgtaagttgagccctttccttcatctctttcttgctcacagatattacaatatctgtgcaaaaatcctaatgcaagaatgagcttagcatattccagggactgtcattaactgaaatacatatataacaaggaggaaaagatacaataaatgtggaatttattctaattacaatggaaagcaagtggagagttttaagtaataagttttatgctttaaatttttttggctgctgcatggaaaagttccttgaaggagaaaatgtgaatagagagtggtgggaatggcagaggactattgcaagagtccagttggttgctgatgttatcttggactagggttatccgtgtggaaatggtaagacaaggtaatattcagacttgccagtgtactacctgtgggtgtgaatgacaaatgtgagattcaaacccaggtctatattgcactaaagtttacaacatttgcacacctctatattccctcaattgggtatcttgtttactttttaaaaaaagacaatataaaacttataagcctagtttttcttcaggttactttgttgctttctgatttaccattcttatcgccctaaaatctaaatgtaattttagagaatatagttatacattgaaaatataagagcatgcatgggtacatggaaattaagtatcttgagagattatatctattctcaaatttacccttgacaatgcaagcagttacaccaaagagatgaaccaattactgtaaacaagacagaaagcacgtaatctttatcttttttctttgtataaataacttgcagcattccagacgtctctctcattgcaaattgatataaccacaaaaggattttgagtataatttcaaggaacatttgtttgcgatcatgcttcccacctcccaccaaaaataataataaagatcatggctagaactaacgctccaagaggtacttttaaccttaaggaagtgtagactttaaaatctattagtgaggcaaaacaaactttgtttcagctagtgctagagaaatcagacccctaccactagagaactataatgcccattaaaaataaaaattaaacacaaattgtgacattaaaaaatatgagtgcctgggtctcatttccaaaggttctagttcaactggtttgagatgaaactcacgaagcagtatttaaatttttttctcagatgattttaatgtacaaataagattgatgagaacagggcttgaggaaaataaattatgttgtcttttttttataatatcttaggatgggaattcatcctcattttccaagttaaaataactgtcttgctctggcaaaactcagacagaactcatggaaaatacaaagttttcatctgtgtgtgtgtgtgtgtgtgtgtgtgtgtgtgtgcatgcacccagaaacacacatgtaagcacacatgtagcaatggtttaaaagaggacttttagagctctacagtcaggtagagacacatatctacgagagaaagcaaacttttcatcataagtcaaaggaaagggatgcaattaagagcgagcacagatctttagaaagcaataccaaatggtttgtaaaaggggatatttgtgaaaatagtgatcgtatgctaaaaattcctcacatttttatttcaatgccaattaaatattccagttttaagtagttcaggatggaatttttagtcacattaagatatcctcctctcaagttctttgctagaggctactagttttgtttccaacattttctgccttatcagctactgactgaaacccattaatgaatttaattctatttaacaaataattaatgaagacctactctaccaaaccaagtatagtaatactcatggaggcaattttccgtaaatatgatgaccagctttatgaacaaaggacttgtagtaagtcccatctgatgatgggtccaaaagtgaatgcaaagtcagggaagttagaatctctagatgcatgcattctgagtgtacaagagaaataaagcctctcaagattcccaaaagatctgtttcttctactttatacatagattcaaaatggataattttgttgatcaagaaatccctttcaaatactacctgaaaggacacaaaacccagggaacatggaagaacggaatcaggtcctgcagagcaaaggagaatacaaataagaaataaaattaacttttgtaacagcagtaagatggttgttagggaattttatttttatagtgaaaacttaaagactgagtttctcaagcgttaaaatgaaaatgtttttatttgtgaattcattcattctgcaattatttagtgaacacctactaatatcagggagcagtttatgaattttgaaaataatgatcaaaacagacataatctctgctttcttgcagcttttatttaagtaagagggtcaaacaaaacacagcctagtgaataagagcattacatagttaggagataataaatgctatgagaaaaaaaagtgcaggataaatgcaagggagggtcagggtgagttggaactttaaatagggtgatgaagaaaagcctctttgagaaggtgatattccagcaaagacctgagggaggtgaggaaattagctgcactaatgcttaaggaaacagggacaaagaaaggtaacattttgagatggtgcaaataatatcacatttatatgctgatgggaaagatctactagcaaaagaaaaacatagtgaagaaggagaaagaagagaaattgtggaaacactgagaaatggaagaggaaaggatctagggaacatgtggaggtatgctttagagaggagcacggaccctgcttgtatactaacaggcggaaaagcagaggaccattttgtgtcagattgaaattccacatactggaaagcccattcctcagagagtgtgcgacaacagcatcaaataacttccataactaatgtttttcttttgtaaaattaaagtttataattaatgacctattgtggttactgattatcttgatagacaggaggaaaacagtgaagagtagtaagactcaggcttacatgcagaagacacatcaagaatagaacagactgcctaacatcactcacctctatatcacaggctttcacgttttttaccaattgcacttggatattgagtggctcgctctagcctatactgtaagggcagtgtgttggaccaagtgaatgtctatgccacttcacagaggtaccattccagatgtttactagtgttccaggtgttgacaagttaggataaatgtgatcacaaagatccttcctttttaccgatcctggctcctcctttgttcagtggccaggcctggcttctgtctcagctagatcattttcttctacaaatttttgctccactatcaagtcctttttgccttttgcacaataaatcttagaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggtatgtctagcatgtgatttactctgcttactgcattttactctttttttcttatagcctacttagttatatacaaacaacttcattcaattcagcaaatcatcaagtagttattgactaagtgtcaagaactatgcttagttcttagctcaagctactgaaatgatgtactgctctctactttagggctgcagataagttggagaaacaaaattgcaaaaggctgctctccctataataggccagatactgtaacaaacacataaccctcgtgctactgacacacagtaaagaatctagcctagcagagtctatgggttcagggaatgttgagactcacaagagttcaatagtgagcagaagtgcaccaggctaacaaaggtgggaaagatactcctggtaaataattagatggtaaagagaagatagatataaatgacagatagatagataggtgagagagagaaagagatgatagaaaatatgctggtatctgtatgtttatttgaatgagttgggtaatctgaaatttaacatgcaataatatctagttaaacagaactatcccttctagactagataaatatttccttgcttggtaaaatttcaaaagaccattgtattctcaatgttgaagaaatagccctgcaccttagagaagaaaaaaatctgtcaggaatacactattttctagtctaacttgtttgtaacagaggccaaaaaaatatggtaaaagccattctctacacaaataaattgaaaagttctacaaagttcaaatgttgaccacacagtgaacctactattgaatttttagatgtgtttttgcttcaaagatgtattgacataaaggtcctttgaaggaatataataattcttttgaaatcattttgaatataccctgtgcgatacagattgaatcatttgtccaagactttttatttctgaagtttctgctgaaagtcaaccttctctagaaccattatcaagttgtaaaagtaaagatttctaacagccttgaggattttgaacttgaagaaaaaaaatttagacattggaaaattgtctttataaaaagtataatatgcaatttaggatctctaaatgtccaactccaacactagtaataatgctttattgccaatgggatggactactcaaaagaaactgacttactgcatggacaggatttatctctcaaactttaatatttcaaaattattctgaattcatttttgaaaaagtaagaatatctgttttctactcaaaggtaaaactctgttgctggtataaatgaagaagttaaaagtagtttcaataactcaataataacatataataatgctaatatataataattgcatgatatattatatattacaatctattattatagtgtgctagttttagagtattgatgttttattgcctctctccatactccttgccaaaaaataatcaagtaaagaaacaacagggaataaagtaaatcccatttcttctaacaacatgttgaactaaaaaacaaaaagatagtagttgatgcttagatataagtaaggtttttggcaatacttgcattgttcacatactggtagaatgtgctgtggggggtcttatgcaaagcagattcctgggattttatcttttaaccagggggtcttagggataacactattttatattagtttactacgatatgaatgactgtttttcttggccatcacttcctcattgtgatagctgtacagtgttaaaaatagatttttgaatattagacagaaaatagaaatgcacatttttatagaattgcagaaagactaagttatgatacatattttaacgtatactttctcaaattcttatttgtattctcatatttaagagtaaaggccaggcacagtggctcatgcctgtaatcccagcactttgggaggccgaggcgggtggatcacctgaggtcaggagttcaagaccaggctggccaacatggtgaaaccccgtttctactaaaaatataaaaactagccgggtgtggtggtggacacctgcaatcccagctacttgggaggctgaggcaggagaattgcttgaatccaggagacggaggttgcagtgagccaacacagtgccactgcactccagcctcggcaacacagtgagactctgtctcaaataaataaataaataaagaccctaagacaaaaaagaaagataactatctgcagtctagagatgaaaccaccttaacagttttaattatattaggttgcattttcaagtgtcagattgtcccaattcatacagtacttttactagttctcagaatgatctgtatagacagtaccatactgtgtcagttccctggcatgggataggatgtagtgaaaaaaaaatcatggaagagaaaataaattattcaagctccagttactaaattccccagtcacttaaccttttggagaatcaattttaacatcggtaaatgtaaggatcactatgaatgctttacctatctcatagatcagttgggaaagtccaatataagaaacatagatctgaaagtggctaagtgatgtgtaaaataatagtttttctattttgcaatgtataatcatggtgggtctaggattgagtctgacactgtccaaatcaaagttctccacttttctctggattacatcctctgctttttcttctggaaatttggtgtattatgattctcctaaattttcaatttctcaatttctaatggctatttatcatcagcatttaaacataatcctaaatttactgtcttaaaaaagagtctttaataattataatcctttttggctatcagcatctctctcctcccttttagagctaaactttcacaaagttgtctatcccaactttcttcatttttatgttcctttccccttccacctcaagcaatgtgaattccaacataaccatctataaaaacagaaatttctctcaaaaattaccactttctgaaggctacatcttctttaactttttattttacattgtttaccaattccttcttcctgaaacacttttgtgggggataagtgtcttccatgaaactgcattttgctacttttctttctgcctttttatctgtttgtctcggtctttttagaagcctccttctcttctgtttatcccttaaagattgacattcttcagaacttaccataggatcttcatgctcttcacctttactttcctcactattaaaatcacatctatttgcatggttttaatacacagcatgctctttcattcatctcagtttattttctcctggacttcagatgcatgggcatatccaattgcttattggatatcttcactccaatgtttcacatgcaattcggactcatcattgttctccactgcctacctcttgtctctctgtcttaatgaatgacatcataatcttctcagtgactgatgccaaatctgagttttatcttagatttctcccttccctcaacttccacaacaaattaataatgtgtcttgccaatcctacttcttaaatatctctcaaacacatcttcatcttttgatcacatcaccaccattttggtcacaactatgtctcatctaaaatactgaaaatattatccaacctatggtagcacaaaagactgactgcagtgtgtttcatggggatgttttggcatcctcattatattaattatctatcgccatataacaaactgacacaaacttagtgccttaaaacaacacagactcctactttacacttactgtgtatgtaagaattgggtatggtttagctgagttccctgctacaggatctctcacaatgctaaaatctagacgtcttatctcaaaactcacccggggaaggatctacttgtaagatgatgtagttgttggcagaattccttttgggttgatgcactgaggaccttagtttcttgatggctgctagtcagaggaagccctttatatcttgtcatgtgagcccctccataatgcagcgtgcaacatggtggcttgttttatcagaactaacaagggatagagtttgatagcaagcccgaggtcagaatcttatgtaactgattcacaaaaatgacatcccatcatctttgaaatattttattggctagaagcaggttatagaccctgtgcacacacaagaggaagacgctgcacacgaggataaataccaagaggcagaaatcaccggaggccatcttggaattgatctgccagatttcattattcctttctgcttcttaaacttcccacagcagcaaacaatgtaggtaaacattgttgcagtctacacagatgcagttttaaggaaaatccctgaggatgcagaggtaggtaataagaccctctcgtgtacttccttattatcctttatttctccttacatagccctacattgtattataattgttgtctcacatgtatattagatagagaccttggttatcatattcatcacaagtgcccagcacagagtctgctgtatagtaagtgttcaaaaaatatttcttacataaataaccccaactaaataaaatgctatgtggcatttttgctctctgtggtttacattcaaaagattgatagatccctcaaatgaataaccttaataaaacaatactgtctttatcaccactgaatttatctaaatccctctagaattatttatggtttttgcttctatcctccccagggttaatgggtactattccttaataactccatctatttgctctaaaattacctctttcttgactcaagaagatactcaatttctgcattctgatttttcaataattaattctatatttatacttctgtacccatcacaaggttgaacattacaatccaaacacttcctgattaaaatgtttcagccttattcttctgttttcatgtagaaaatgcccaatccctttggtaagttgcctggatcttctccaactgcatatcttctttagggtacaatgatcagcacttcacagttttgtttaaggaaagataaaattcgtaatgctaagttgagatacaaaaataaagatggtgccatttctcctagatctttataataaccttagttgtaaggtaaattagtggctgggctggcatgaagtctgaaatattggtttggatgcattgaatgctaatggaaaaacctgctccaggtagagttttgtgatagagtttatcttctgtgaactttattactcttttgttaacttccatttgtccataatatagtccctccctgaaggttccaaggtgcatcagaccttttttaaagtaccttatgactactaaccaaatgataaaaaactaagttggaaaatgggattggaaccagttacaggggaacatagatcccagctatgccatttgacccagtgctgataataaaaaaagacataataccaaactctgtaatcctgaatgttgaaatcccaaaagattaaattccttaaatctgaaatctataacatctaaaatccagaaaatcaccatctcggaagattaaaatcacaaatattgaaatcctgaaagccaaattctatggaaggcattagtgcattttcagttgcacacaggatagttgcatcatgttagttgcataatgttaggtgggacaataatattaccttgttattgtctttatttggaaattaagtatgatttaaggagacatgtatgggtgccaagttgacaaggagtgaacttgtggacttaattgtctgggtcaacttgactagattaaggaataccaagaaacctggtgaagtattattttgggtgtgtctgtgagagtgtttccagaggagatcagtgtgtgagtctgagcagactaggtagggaagatccgctctaatttgtttcatgcatgttttgcaaatttgattccacgaaagtgaattattacaatgtttactttttgtgtaagcaccatccaactggctgagggcctagagagaacaaatacagaagacaaactgatctctgagagctggggcaaatttttctttagcttcctaggatgtcagaactttgggctcaccggcctttgaactccaggacttacaccagtcctcccaaccaggtcctgaaactttcaatgctgaactgagaattacaccattggctttcttgtttctgaagatttcgaattttgattgaaccatactgctggcatccctgggtcttcatcttgcagacagcctgtagtgagacttctcagcctccataatcacattagccaattactataatgaagtccttctcatgtatctatatatcatcttggttctgtctctctggagaagcctgatgaatactgatttggtatttaggaaatcaaatattattccttcttactgtattttatttcttacaacataatagaagagatttgtgaaattgtttcctcacaaggaagctgtaatacaataaatgcatgaggctactcaatggtgaaacacaaaatttaaaagctaattgttattggtgctgcaaaagcagaaaatcacttagttacaatagctgagcaataaccagcccaaaaatggacagcatatacttacaaaatttgtagaccacaaccacactccaaataccagtgcagcaagtgttttgaagatcccagaagtgaaaattcaggtgaaaaagacaagaaatccctgccaaacaatttaatctgtatgacttccgctcctttacacaaaattgttgttatatatttcattttagcatcattttcaatactggaatttaaaattgtataaataattttaaagagctctaatttgtttcatgcatgttttgcaaatttgattccacgaaagtgaattatcacaatgtttactttttgtgtaagaattttgcatatatgtaaaaacactgaaaacttcttcagtaaatgaaggaaggttcttcttttatatctgcagcttttgtgaaagataagatttctctttgggcaactgcacatgccgtggtgacccatggcagtttttgatggatctcatcaaaactcaggttgcttgtcgtaatatttcacatgaaaatggttacaaactggatgcatgcaattactaaccatagtcatatatgtttatacattttggtttcagacttatgtcatatgaatacagctcattttctcataactgttatatcagtgtgactatcattagtttccctgagtgtttatgcttgtgaaaatgttttattattgcctactttattgtgtaaagtggcccataaagtgttctgtcatgtttttatatgtttcttaagtaaatattcttttaaaaatgagatacattatattttaaggaattaaaaaatttgtttttagaattatgttttccagattttgatctctcaggatttcaacaatcaggattatgccttatggattatggctaaaatctgttttggtttaatcccataggctgtgaggagccattgagagttttggtgcagaggaatcacatgatgaaaactgagcatagaaaggatgaaaaatgcatttagagattgtcactataatttcaggaagaagtaaagaggctgaagaataatgatgatgttgacaatgttttaaaaagtataaatatggccaggcacggtggctcatgcctgtaatgccagcagtgagaccccacctctacaaaaaataaaaagtgcagtggttcatgtctgtagtaccagccactcaggaagctgaggtggtaggattgcttaagcctaggaggttgaggctacagtgagtcatgatcatgcaactgtactccagcctagacaaaagagcaagactctgtcaaaaaaaaaaaaaaaaaaaaaaaaaaagggtacaaaaatgttatagtatgaacgtattgggagaaaggacattcatattggcttacagattttgaacctggataaaaatgtatccttagatagaagtaataagttctagtgtttgatagcacattagagttttgatgagatccatcaaaaactgctgtagttcatcactgcatatgcagttgcccaaagagacaagatcctgagaaatcttatctttcacaaatgctgcagatgtaaaagaacctttcttcatttattaaagaagtttcaatgtttttacatataggcataatgcttacacaaaaagtaaacattgagctaatgcactttcatggaatcaaatttgcaaaacatgcataaagcaaattataactctttaaaattctttacacaattttaaattccagtattgaaaatgatgctaaaatgaagtacataatagcaattttgtgctatgtgtagaggagcagaagtcatacaagattaaattattatttatttatttatttattattttttgagatggagtctttctctgtcacccaggctagagagtgcagtggcgtgatctcggctcactgcaacctctgcctcccaggttcaaacgattctcctgcctcagcttcacgagtagctgggactaaaggcgcacgctaccacacccagctaattttttgtatttttagtagagatggggtttcaccgtgttagccaggacggttttggtctcctgacctcatgatgcaccagcctcggcctcccaaagtgctgggattacaggcatgagccaccacgcctggccaagcttaaattattgaattaagaaattacaacagggaaataatgacagagaaaactagaggaataattagcatattatttaaatctatgcaaataagatttaaagca

SEQ ID NO: 870 - DNA, 9303 bp, Homo sapiens
accagagttcatagttacaggttagtcatagacaagaatttaggattcttagaaatccccagtttaagtggtttgagtactctgggggatttggtttgctgtatagtaatggagttgattgtacagtggtacccatatcaataagaaagctatattattatctatttatattataagtaattcccaatggagctttaaaacgagatagaaaattgctggtgcttatgtttctgttggatcaactgtctttggacagttttttttttttttaatcagtgtgaggcattgatgttccaatgatcttttcttccaatatctacaagaatccttacttataagctttatgttcttagatagtagaaaatcctttcttactgtgtttgtttgtttgtgtgtttgtctcatctggagagctggagtatatatatagagtggaatgattgccacaatcaaagtagctaatacattcgtcacctcacataattaccattgttttccttttgtggtgtgaacacttaagatctactctcttacaaaatttcaaatatcaaatatagcataattaatgatagacactatgttgtaccttagatccccagaactttttaatcttacaattgaaagtttgtagtctttaccaacatctacccaaaccttgccccttccaaaccttacccctggaaaccatcattctagtatgtgcctttatgagcttgactttttactattacacatacaagtgagaacaaacagtatttttctctctgtgtctggcatatttcacttagcataccgttctctagtgttattaatattgccacaaatgacagaatttccttccttttatggctaaatactattccattgtatgtatagacaacattttctttataaaatcattcattgattcacaatttggttgttttcatattttgactattgtgaagaatgttgcaataatcatgaggttgcaaatatctttttgaaaaacttatttcatttccttcatttatatatccagaagtggaattgctgtttcatacgggtagtttcatttttactttttctgaggatcctccacaccgttttttatgatggctctaccaatttacattcccatcaacagtgtaaaagggttccctattctctacatcttcaccagtacttattgtctctttgctttttgataagaaccttcctaacaggtatgaggtgatatttcattgtattcttgatttgcatttccctgatgattagtgatgttgaacactttcagatagctggcagttgtttgtatatcttctttggaaaaatgcctattcagaatctttgcccattatttaatagggttgtttatctatttttgctattgacctgtagaagattattacctaatttggatatcaactctttatcagatagtttgaaaatattttctcccattttgtaggttgccttcttatttttagttgtattatatctttcagttccagaatctctgtttgattcttttttttatggtttctattttttcattaaacttctcattgtcttcatgcagttttcctgattttgtttagttgtatatctgtgttctcttgtatcttgttgaactcaagataatttttttaaaattgtttgttaggtaatttatagatttctgcttctttggggtagtttattgacactttattgatttcctatggtgatgttgtgttagtctgactctctatgatttgtgtggcattgagtttgtgtctgtgtattaaggggcaaaacactttttctaatctttacagatgggtttcagcaggcaaaaaccttctcctgtcaatttcttgggctaatgagattccctttgggatccaggttgagtggggttggagccaggtcacatggctgctactagatctgaggttgacagccctatggctaggagttcaggtgggtatagctcttgcttaatctttgaataggcaagactacattcagaaccttggtcagtagagctggtactgaaacaagtttcaaggtctgcagttagttctgcacgtggtagacctgttaccagattcatgtgtagttttggctcctgcaggttccctgagaatattccccctaggtcactgggtgtatttctgggtgtttatggctgctcctgaccacagctgagggagaatggagctgggtcatgggccacttcaggatccactcccagaaccaagttggtgggcctgttacttgaggcatgggaaggtgtggctccatttgggtgtcctggagtatggcgctggtggcaggaccaaggccaattggagctgtaactgaatccacaggggtatggggctgtttctgggttcctagtcaagaccatgatcaatgagcctgtcatcaggttgcaggcctgatctctcaatatagctctctttggtcttcagattcatgaggatttcacaacatgctacttggatttcattgctctacaaaaaagtatttttgtctggataactaccaaattattactgctggaagggaatgtgagtggaggacctacggttctgccattttactgttctcactccccaccaaatctactgtgaagaaaaaggggtttctaacggtcttatataatgtatttcctacttgttcttggcttttcaaggccaaatttttgacatatgtgtattgggttttttagatttcctcctgatgttttctattatgctgctttcaacttgtaattaagaaaaaaagttgataaaaatttagtactccaagacgttaattatctaagaaaacactgaattgcacagcagattttacctattttttgaggcttagggaaattcttaattatagttcttaagaactctagactaaggtttaagtacaacttctatagacctgccttctagtccagcaatgggatttttaaaatgcaattgtttatttcctgagaaataccatgaggaaaatgtttcttatttatgaggtcaggggaaagagcagaaggaatataagtggtataatttatgaggaaattaagtctgagagtaaaagaggtacaagagggggaggcttcagagatttggaaggagtttgattgttttttccttggacttttctacaaagtctttgagggtttctatcttggagtcaatattttgattttaggacttcatataagaaagtcaatcacagattacttggtatttgtctcaggtctttttttttttcagagctcctcgtaaatgtattattcttgatatgtcagaagtttcccatattggccattgtaattcttattaaatcttcctatttatcaagataagcataattatttgagttagagtaagacaaaatataggaagcagacgttctgccagaggaaagtcagctttaatgtagagatgaacttgagattaacaaaaaagtgcactaaaaacagtaaactctctgtatttgtgaatagtgtcttggccttccccaatcaagcaaaggtatgccaacaatgcctcaataatttgtttaatttgtttcagctttattgaggtataatgatatacaaaaattttcatgcatttaatgtatacattttgataaatttagatacctgtgtatacccatggtaccatcacaacacccaagatactaaacatattcatcacctccaaaagttttcttgtgttttttatttagtggtgtgtaggttttgtttgtctttgtttgtttgataagagcatgaggtctttcctttaacttattttaatgtatataacactgtattgttaaccctaggtactatgttatgcagcaagtctctagaatgtatttttattgtaaaactgaaacttcgtacccactgggcaacaattttccattttccccaaccttatcccccggaaatcagcattctactctgtgtatctatgaatttcactcttttagacaccccatacaagtgaaataatgcaagatttgtctatctgttactgggttgtttcacttagcatagtgttctctaggtatgtctatgttgcaaatggcaggatgtccttcttattttaagaatgaataatattccattgtatgtatttaccacactttctttatctaactgttaataaacatttcatttttttccatatcttggctattgtgaataatattgcagaacctgggagtaaaaatatctctgtgagactgatttcaatttttttggacataaaaccgtaagtgaaattattggattatatagcatttttaattttaaatattttgagaaacctccttactgttttgtataagggcaaacaattctaaattcccaccaactgtatagaaggagtcccattcctccacatctttgataaaatttgttatattttgacttaataatggtcatcctaatagggctgagttaatatctcattgtggtttcaacatgaatttacctgatgattagtgatgttgaacaccctttcatatatgtggtggccatgtgtatatattctttggagataagtctattcaaatcctttgtgcattttaaaatctagatatgtatgagtttttttgctgttgagttttaggagattattattatattcttggatattaactccttatcagacacatagtttgagaatagtttatcccattctgcatgttgtctttttactgtgttgattgtatataattcattgtgcagaaggtttttagttaaaattagtttcatgtgtctatttctggttttgctgcctgtgcctttagtgtcaaatccaataaatcattgccaaaaacaatatcaagaaaattttatccattttcttcaaggagctttacagtttcatgacttagtgtttaatacatttttagttggtttttgtgtatagcacaaagtatggagttccatttcatttttttgcatgtggatgtcgaccacaaatttggaagtggctatcctttctccagtgtgtgatcttgacacccttgtcaaagatcagttggctgcacatgcacgggtttatttcttggttctctattctattctcttggtctatgtgcttatctttatattagtatactgtttctattattgtagctttgtaatatattttggaatcagggaatgtgatgtctccagccttgttctttctcaaaatcactttggcaattcggagtcttctgtggctccacatgaattttagtattgttttttctatttctgtaaacaatgccattgggattttgacagggataacattgaatctgtcgattgctggtcataatatggacatttaacaatataatccttttctataaacagggaatgtctttccatttatttgtctagtttaatttctttcatcagtgttttataagttttcaatgttcaagttttatctttatggttaaatttattcctaagtattttatcatttttaatgctgttggtaataggattgttctcttaatttccttttcagatagttcattgttactgtgtagaactacaagtgatttttatgtattaaattgtattctgcaagtttgcttaatttcttgattaattcttacagatttgcgaagtctttgggagttttgtacatataggattataccatcttcaaacagaggcaattttactgctcctttaaaatttggatgcattttattttgctgctgttattgcctaatttctttgggtaggatttgtagtactacgttgactagaattggtataagaggaggcatccttgtcttgttcttgatcttagacaaaaatactttgagtttttcaccattcagtatgatgttagctgtggaattgtcatatatggacttcattatagtgaattcatcaacaattgttgacctcagaatataagccaaacaaagcagctttctttcacaattttccctcatgaaggctttgtaggaaacctgaggcaaagtttgaccaattgccttttctacaaatggactgctggtctaacagactacaaacttttgatatgtaaaactttattccgtatagtgttgatttttgtatatggatactaaccgaacctttaaaaattataattttatttatgaatatcaattctcattttattttatattcttgctattgttggtataagagaataatattgtttgtgtgtgtgtccatgcacaaattgatcattttttttctgtcaaccctccttaaatctcttataagttctctaatatttattgaataaataagcctgtgttgggtgtaatatatgtgagtgttttactatcttcatatatctctctaaatcctagacactagactttttagaaaactgttaagtacagaatctgctgaccttcacccaagaagttagtgtcttttatatttgctgcagtaaactacacatttccctgttagagaaatgagatcattttgattgcattattcttatttgctcctctcaatctggcttaggtaatttttatgggaaatcatcaaaaggcagcaaattattttaatgatacttgtggatttctaataacagatatgtatttaaaattccaaaatcttaattctgctaggacactggtttttctagaattgctccttaactaaatcctttcccaaagcaaaaagacctcaaaagccttgcaagtcttcaaaggttcatccctgttaaggtaaagaatttcatggcattgcaattctttatgtctcagtagggtattttccaataacatctcatcaggagacatttcatgactacttcattgtctcacctgatcaagagggattctctttacttctctataataacaacatgaagtctagagtgtgagtgtctttgactcaccagtagtgtatcatattaatgaaacaagcagttcactatttttcctggaccattttttaactcttatctcttatgtgtgatctatgtctgcttagtacatttgagtggagccacttcaaagatagttcatctctccctcaggaaaaaaaaagggtaaagtgtctcagaatttttttctgagggtaaaatcagcaaagtataatacaatgcaatacactgatgtcatcagaatccatacatagccatttgcagcatttactttcagctaccaaggaaacatagaatcaggctattcaatggtaatttctggaaaaaaattaacttaataacccttgaattatggagtaaaatttgattgtttcatgagtaaaaggactagatttacttccatttagatatatagtgacttataataactaaaaacttacagaatatcacattaaaaaatcttaaaattatggtttttatttcaagattaaatgtggactgcagttaatatgtagctgtgtatatagtatctaagtatgctataaagtaattttcaaaataagaaaatcattaatttatgaagacattactacccataaaatacttttcatatacatgtactaaacatccagaaatgtaaatatgaatttcagagtctgttttttcttttttcttagcaaaatattatttcatggaacattttttaatcacatttttcctcctttcctattctctctaaactacctatcacatagcctcttcctctatcctcttttgaaaatcattttgctgggatctcaattacctcttaattgcccagtctagagaagacagtgcatttaatgtcttctaagacctctcagttgcattgcatatttttgaccttacgctcattattgcaattcttctttgctttctgggacacaatgttttgcttatacgcatgccaccaccctgaaattctgtgcttggctttcttctcacttatattctctctctgagtcatttcatctatttctataacatcaaatactctttacaggcagaattctactaagtctatacagttggcccttgaacaatatgggtttgaactgcacaggtccacttatatgcaaatttttgtcaataaaatatacactgagtgtgcctgcctctctctaatgcctcctctccatctcctccacctcttctgtctctaccaccagagacagcatgatcaaaccctccttttcccccacctcctcagcctactcagcatgaagataaaggatgaagacatttttgatgatctacttccatacaatgaatagtaaatatattttctcttccttttgattttcttaataacattttttctatagcttactttattataagaccatagtatataaagtatacaacataaaaatatgtgccaattgactcatgttatcagcaaggctgtggtcaacagtaggatactaatagttagattttaaaggagtcaaaatttgtacatagatttttggctttgtgggtgtcagcacccctcactcccatgttgatcaaggtcaactgtattttcattgcagaactattatctgaattctggactattattatcaactctggttctgggcatcatatgcatcacatgctgaactcataagctctactccataagcatttatttacctactctgacctgttttagttagaagaaccatttttttctgttatattcttaagtctgaacctttcatgttccagatttagatttcactatcaaattctatttatatggagtatatcttgtctattttactccgtatttctcattcagtctgcttattagccacctaactagtgttttgttctttatttttatgcagtccattcttcacaattttagtagaataatctttcaaatattaaataagtacttcaacttaaattgatttggtatacaaaataaaataattggtttttgtaaaattgcaagatagttactcaaaatctagcaaatatttcttattgcatttgtgatgtctatataattgtataatcaattcttatacacaattgagtctctttctgggcaatcctttccaatccattgttattgttgctgatttgtggactgtgctactctatattatgtattatgcctttatgatttagtcagatattttaaaaatccatattcttcacaatagtcttttatttataaattactttttatatagtcacctattgatcttttttcaaataattttgtgactcccccagaatttcatttgaattgcattggagctatggtataatattgggagaactgattatttttgtgtatcattgcttttgaataatatgatataccaacccatttattctctcaaagtgttatatccctaaattaaaaaaaagttgtttctttatagatttcaaacagggaattagaaagaggattgaaaga

SEQ ID NO: 871 - DNA, 5876 bp, Homo sapiens
aaaaaagtgcactaaaaacagtaaactctctgtatttgtgaatagtgtcttggccttccccaatcaagcaaaggtatgccaacaatgcctcaataatttgtttaatttgtttcagctttattgaggtataatgatatacaaaaattttcatgcatttaatgtatacattttgataaatttagatacctgtgtatacccatggtaccatcacaacacccaagatactaaacatattcatcacctccaaaagttttcttgtgttttttatttagtggtgtgtaggttttgtttgtctttgtttgtttgataagagcatgaggtctttcctttaacttattttaatgtatataacactgtattgttaaccctaggtactatgttatgcagcaagtctctagaatgtatttttattgtaaaactgaaacttcgtacccactgggcaacaattttccattttccccaaccttatcccccggaaatcagcattctactctgtgtatctatgaatttcactcttttagacaccccatacaagtgaaataatgcaagatttgtctatctgttactgggttgtttcacttagcatagtgttctctaggtatgtctatgttgcaaatggcaggatgtccttcttattttaagaatgaataatattccattgtatgtatttaccacactttctttatctaactgttaataaacatttcatttttttccatatcttggctattgtgaataatattgcagaacctgggagtaaaaatatctctgtgagactgatttcaatttttttggacataaaaccgtaagtgaaattattggattatatagcatttttaattttaaatattttgagaaacctccttactgttttgtataagggcaaacaattctaaattcccaccaactgtatagaaggagtcccattcctccacatctttgataaaatttgttatattttgacttaataatggtcatcctaatagggctgagttaatatctcattgtggtttcaacatgaatttacctgatgattagtgatgttgaacaccctttcatatatgtggtggccatgtgtatatattctttggagataagtctattcaaatcctttgtgcattttaaaatctagatatgtatgagtttttttgctgttgagttttaggagattattattatattcttggatattaactccttatcagacacatagtttgagaatagtttatcccattctgcatgttgtctttttactgtgttgattgtatataattcattgtgcagaaggtttttagttaaaattagtttcatgtgtctatttctggttttgctgcctgtgcctttagtgtcaaatccaataaatcattgccaaaaacaatatcaagaaaattttatccattttcttcaaggagctttacagtttcatgacttagtgtttaatacatttttagttggtttttgtgtatagcacaaagtatggagttccatttcatttttttgcatgtggatgtcgaccacaaatttggaagtggctatcctttctccagtgtgtgatcttgacacccttgtcaaagatcagttggctgcacatgcacgggtttatttcttggttctctattctattctcttggtctatgtgcttatctttatattagtatactgtttctattattgtagctttgtaatatattttggaatcagggaatgtgatgtctccagccttgttctttctcaaaatcactttggcaattcggagtcttctgtggctccacatgaattttagtattgttttttctatttctgtaaacaatgccattgggattttgacagggataacattgaatctgtcgattgctggtcataatatggacatttaacaatataatccttttctataaacagggaatgtctttccatttatttgtctagtttaatttctttcatcagtgttttataagttttcaatgttcaagttttatctttatggttaaatttattcctaagtattttatcatttttaatgctgttggtaataggattgttctcttaatttccttttcagatagttcattgttactgtgtagaactacaagtgatttttatgtattaaattgtattctgcaagtttgcttaatttcttgattaattcttacagatttgcgaagtctttgggagttttgtacatataggattataccatcttcaaacagaggcaattttactgctcctttaaaatttggatgcattttattttgctgctgttattgcctaatttctttgggtaggatttgtagtactacgttgactagaattggtataagaggaggcatccttgtcttgttcttgatcttagacaaaaatactttgagtttttcaccattcagtatgatgttagctgtggaattgtcatatatggacttcattatagtgaattcatcaacaattgttgacctcagaatataagccaaacaaagcagctttctttcacaattttccctcatgaaggctttgtaggaaacctgaggcaaagtttgaccaattgccttttctacaaatggactgctggtctaacagactacaaacttttgatatgtaaaactttattccgtatagtgttgatttttgtatatggatactaaccgaacctttaaaaattataattttatttatgaatatcaattctcattttattttatattcttgctattgttggtataagagaataatattgtttgtgtgtgtgtccatgcacaaattgatcattttttttctgtcaaccctccttaaatctcttataagttctctaatatttattgaataaataagcctgtgttgggtgtaatatatgtgagtgttttactatcttcatatatctctctaaatcctagacactagactttttagaaaactgttaagtacagaatctgctgaccttcacccaagaagttagtgtcttttatatttgctgcagtaaactacacatttccctgttagagaaatgagatcattttgattgcattattcttatttgctcctctcaatctggcttaggtaatttttatgggaaatcatcaaaaggcagcaaattattttaatgatacttgtggatttctaataacagatatgtatttaaaattccaaaatcttaattctgctaggacactggtttttctagaattgctccttaactaaatcctttcccaaagcaaaaagacctcaaaagccttgcaagtcttcaaaggttcatccctgttaaggtaaagaatttcatggcattgcaattctttatgtctcagtagggtattttccaataacatctcatcaggagacatttcatgactacttcattgtctcacctgatcaagagggattctctttacttctctataataacaacatgaagtctagagtgtgagtgtctttgactcaccagtagtgtatcatattaatgaaacaagcagttcactatttttcctggaccattttttaactcttatctcttatgtgtgatctatgtctgcttagtacatttgagtggagccacttcaaagatagttcatctctccctcaggaaaaaaaaagggtaaagtgtctcagaatttttttctgagggtaaaatcagcaaagtataatacaatgcaatacactgatgtcatcagaatccatacatagccatttgcagcatttactttcagctaccaaggaaacatagaatcaggctattcaatggtaatttctggaaaaaaattaacttaataacccttgaattatggagtaaaatttgattgtttcatgagtaaaaggactagatttacttccatttagatatatagtgacttataataactaaaaacttacagaatatcacattaaaaaatcttaaaattatggtttttatttcaagattaaatgtggactgcagttaatatgtagctgtgtatatagtatctaagtatgctataaagtaattttcaaaataagaaaatcattaatttatgaagacattactacccataaaatacttttcatatacatgtactaaacatccagaaatgtaaatatgaatttcagagtctgttttttcttttttcttagcaaaatattatttcatggaacattttttaatcacatttttcctcctttcctattctctctaaactacctatcacatagcctcttcctctatcctcttttgaaaatcattttgctgggatctcaattacctcttaattgcccagtctagagaagacagtgcatttaatgtcttctaagacctctcagttgcattgcatatttttgaccttacgctcattattgcaattcttctttgctttctgggacacaatgttttgcttatacgcatgccaccaccctgaaattctgtgcttggctttcttctcacttatattctctctctgagtcatttcatctatttctataacatcaaatactctttacaggcagaattctactaagtctatacagttggcccttgaacaatatgggtttgaactgcacaggtccacttatatgcaaatttttgtcaataaaatatacactgagtgtgcctgcctctctctaatgcctcctctccatctcctccacctcttctgtctctaccaccagagacagcatgatcaaaccctccttttcccccacctcctcagcctactcagcatgaagataaaggatgaagacatttttgatgatctacttccatacaatgaatagtaaatatattttctcttccttttgattttcttaataacattttttctatagcttactttattataagaccatagtatataaagtatacaacataaaaatatgtgccaattgactcatgttatcagcaaggctgtggtcaacagtaggatactaatagttagattttaaaggagtcaaaatttgtacatagatttttggctttgtgggtgtcagcacccctcactcccatgttgatcaaggtcaactgtattttcattgcagaactattatctgaattctggactattattatcaactctggttctgggcatcatatgcatcacatgctgaactcataagctctactccataagcatttatttacctactctgacctgttttagttagaagaaccatttttttctgttatattcttaagtctgaacctttcatgttccagatttagatttcactatcaaattctatttatatggagtatatcttgtctattttactccgtatttctcattcagtctgcttattagccacctaactagtgttttgttctttatttttatgcagtccattcttcacaattttagtagaataatctttcaaatattaaataagtacttcaacttaaattgatttggtatacaaaataaaataattggtttttgtaaaattgcaagatagttactcaaaatctagcaaatatttcttattgcatttgtgatgtctatataattgtataatcaattcttatacacaattgagtctctttctgggcaatcctttccaatccattgttattgttgctgatttgtggactgtgctactctatattatgtattatgcctttatgatttagtcagatattttaaaaatccatattcttcacaatagtcttttatttataaattactttttatatagtcacctattgatcttttttcaaataattttgtgactcccccagaatttcatttgaattgcattggagctatggtataatattgggagaactgattatttttgtgtatcattgcttttgaataatatgatataccaacccatttattctctcaaagtgttatatccctaaattaaaaaaaagttgtttctttatagatttcaaacagggaattagaaagaggattgaaaga

SEQ ID NO: 872 - DNA, 230855 bp, Homo sapiens
acatgctttatcaaacatcaccaaatatcccaaatctagtgaataattttctgtgcatggtgtaggggaagaaaaaataattttacttctacacttctaaattttcagctgggactcctgtaacagaaaacagataaataagggaaaagtaaacaagcttattaacatctatatctcataaacacatgggagatactcagggaatgagtaattctcaaaaggttagcctaaaactctggtttatatagcatcttcaactgaaacaaagaaaaaagatatgaggaagttcagttgtaaggaggcgaccaggaaaaatatggtaaacaagaataagatttgttatgcagatttaagtccctgccttccctattgatgaatctcttgggatttagtcatccttcttttcctggtacagagagggagacactattgaaaggagattttctttatagatgcattttttttctttttctttttctttttctttttttttacaaaagggtatgttctactctgtgtttagaacttctcctgtgtctgctgtttctcaaaataatccttgtgctaaaaagacatattttgggctggcatattctggtctcctgcagtggttagttctacttctttgtagcatttgaaccctgacacgttttctcttgatttctaggacataattttctcttttcagtctctctctttatggttgtatgcctttcttcagttgctcctttctcctaccagtttctctgacatgagaatattatacaacacttgattcctcgccctctttttattttactctataatattctctcttggtgatcttattcaaacccaaggcttcaactgctataactacccagctgatctgtctcctgccaagccctctttctagagttgttctttaggtataccctatatcaattaggaaagtgtcagctgtaactaacagaaaatttgacaaacagtagctgaaagaaatagggcatattttttccacacatgttaactattaattccagaggtaggcagccagtggcttttgcaggagtccgtctagtcattaatatcccagagttccagctgcctttctgctccagaattattacattgtttttgtcaataatgcttattgcttcctagtcacacaatggctgttgcatctcttggcattgcatccgtgatccagaaagagagaaaaaggaggaaatctgtctctttttattaggaaacagaatcttcactagaaatctcaccaagcacatattcagatatgtctctgataaactgtctatatggccacctgtaacttcaatgtgggctataagattattaagatttttctcctttataattgagaaaggcaaggctgaatgtagttatgaatagctcatctacagtttgggtacccaatccacagtttgggcccatttatttacatactttacatctccacctggatattccgtggacactttaaactcagcctgttgatgtaaaatatatatcccctctcttgtaatccctatctccatgaaatttattattggttaaaacggaaactcaaagtccttctagactcttcctacctccttacccaattatttaccaggtcctataacattagtatcttaaagaaaacttatttcctttgttaatgtatgcccctggtcaacagacaaaatgaactccctatggccaactgaggtgcttaaagttaaaacagaacctggtagccatagtaatatgcctccgatgactggagggacaccagggttcttgatctcacatggatgggattaacagtacagacacatgtggagtagttttaaggagagaaaagtttaatgggcaagaaagaaagaaggaaggaagaagaaaacagctcccccgtacagagacagagggaggggggatttgaacaaagagaaaacctgtgtggtgtggaaaagtggctgcttatattgggatgctctaggaggcggtgtctggtttccatagggcccaggggactggtttgaccaggtgtgtcattcatgaagcccacgaaaaaactcgccctcccaccctagccttttaatatgcaagtgcagggcaccatgatgttctacacacatggggatatgcggggttgccatgtcatgttgctaggcacatgtgggggcaagggcaagaagaagatggcaggaatcaccatgtttaggtggaccccgtttctaatggccaacatttgcatatcaaagcttgccagccaagctctaagagctggtgctttcctgctagtcaacaaacatttctagagctgctttaaaagaaatgaaaacttcccaaggaccccaaggaccccctttccctctatctgcctaaaataatttcttaataactcctttaacaatagcagagtgaaggagtggtcttgtactttatattttcagaaagatgtaaaagtgtcacaggacctccctttctgcagtcaagccaaaccagttcctgttgtctgtgcagagatagacatcagctagctattctcccaagtggccaccagcagaccatttgatgccagccagtaaagaaagacttgcaatgtctgacttaaagaccattccattgaaccctgcacctgattgctccccgcgtcctatgctttttgcctttttaaacttccgctccctaaaccttcctcagacatcacttagtgttgcactgaaagctgcatctccccagtctccaagttgcctttagaaaataaagttccccttttgcctctgcagatcttactggtctgttaatacctttgctcaaagaaggacagatctcggcccagatctttatcatttctcatttggatcacaaaagtaattttctaattggtttacttgtctctttaaaccactgcaagtcatcctctacagtagtgtttctcaaaccttaatgtggagataaattggctgagaaacttgttaaagtgcagattttgatttagtagggttctttttctgagacggagtctctctctgtcacccaggctggagtgcagtggctccatcttggcttggctcactgcaagctccacctcccaggttcacaccattctcctgcctcagcctcctgagtggctgggactacaggcacttgccaccacgcctggctaattttttgtatttttagtagagacggggtttcaccgtgttagccaggatgttctcaatctcctgacctcgtgatctgcccacctcggcctcccaaagtgctgagattacaggcctgagccaccgcacccggctgatttagtaggtctttagaggggctgagtttcagcctttctaaaaagtttcagcattcctttattttttaaattttttagagacagcgtgttactctgtcacccaggatggagtgctgtggcacaattatagctcattgtaacctcgaactcctaggctcaagggatcctcctacatcagcctcctgagtggctggaactgcagttgtgtaccaccacacctggctaattaaatatgcatatttttgtagagatggggtctctttatgttgcccaggctggtctctaactcttggcctcaagcaatctttctaacttgccttccaaattgctgagattacagacatgagctactgtgcctggccaagtttcagcatttctaaaaaatttcagaagctgctgtcctgtgggccacactctgagaaacaaggctctgcaatgatgtgatgaaatgcaaatttcattatattacactactgcctaaaaccctacagtcaaaattccattttaactatgaaggaataaggttgcagtacactgaaacttttcataggtaaggataatctttggagaaagaaagcaaaacaaaacaagtgcttgaaggctctggagcatgacccaaggcagacagattttgaaggggataaaaacttggaaaaagtaagtggtaaataataagcctcctgacttgtggttgtagcctcatttcttggtgtatgacaattgacacttctgtagaaaacctgctggctttatatccagaagcatcaagagacagagcctgtggcaacgacagctggaggaaagagaggagttcgtcccagaatggaatgatccagaaaatggaagctgaggtatgtgtgggaactttaaccaaatgcctggctgactgagaactgcacttgaaacaacagactcaaagatgttaaaaatgaaaggattgagatttgaattgtcacttgctgcaagggaaatagaattagagtttggtgtaatcaagttaattgcctgcattttctgccaaaataaaaataacattattcagaacaatataacaaaactagacactctacacatatattgtgcaatatatagaaccaaatccttttttttttttttagcttgaaatatgaaaagctgggaaaaacgtgagtcattttcaaggcaaaaaaacatcagctgagatcaactcctagctgttccatagttttgatttttttgttttaaagtagctgttataagtgggcacaaatagtaattaaagaaaaaaatctttatagatgaaaagaaagtatcaggggatctgaaaaatacctgaaatataaaatagtgcataggtttagaaacacaataaatatgatagagtcagtggatttaaaaaaactaaagatgagagagaatatattttaaaaaatagaacagaatttcacagacttggaaaaatttcaacaaatttaaaatataggcaaccacaatgtagaataaaaagagaaaaagaatgaatcccaaaaaaatatttaaatagtgaaatttcctaaagttcttaaatgatgtgcatttacaacactttcaagaagctcagaaaaccccaaacagggtaaattacaagataacttcacataggaacatcatagtcaaactcttgttaactaaggataaaaatgaaatcttggaagtagccgaagagaaaaataacaatgtacacacagaggaacaatagttaaaatgactctggatttatcagaaaccatggcaatcaaacaatagtggaataacatctgtgatcaacttatccatgtatagtacttactctggtaaaatattctgtaagaatacattttcagataaaggagagcgaaggaaattatctgacagccaattggtactgtaagaatgctaaggaagtgcttccttccttcctgctgagggagactgattccagaaagaaacttagacttttagaattgactgaagaccttgagaaaaagtgaatatttcagtaacataaaatataattttttaaagattctgtttaataaatctgactgtttaaaacaaaaaccatatagtaatgtcttctggagtttataatataaacaggtggatacatataacaaccctaacatagcatataggagagtaaattgttacatggttaaacaaggcttcttaattttacatgaactggtctggtagtaactctacatagtatatacaaatttaaatatgcaaatttttgtttctagaacaaccacaaattaatacaaataaatgtagcttaaaagctaacaaaaaaattaaaaaggaattttgaaataattaaaagaattgtaggcaaaatggggatcaatgtaaataacttagcaagaacaaagttaaataataaaatgatagacctaaatgcagtcatatcaacaactaaaataaatcttaatggactaaagccttcgatttaaagatagatgtttttgcctccaagatggaagattggagacttgagtgggcctcagccacttggaaatagcaaaatagtgcataaagataaactctgtgagccctgcttcaaaaaggaaaatgggaatccagcagcattgtgaaggacaccccagatgctggggaggagaatgtgggcaaacagtccccatgatggtgtccagctgatagaagtgagtgaagccccagtatgtaacaggggcaaagaccctccctctttgactcacctgtacactggggatctgagcaacccagggttagggagagcactttgtttctctcatgccctggcactaacttgggaagaggctgggagatgctgagagggaaagacattagaaaaagctccatgcagtttcccagacccaagattgagagaaggatggcatttttaatttgggtgcatacaaagtcaatcattctttggtgacctggcactatggacatgcaggcattttagtctcaggcaaaagattggagtgcttgctccagggcagggtagggccctccacagccagaattatggaaagcacctcagttgtaggtgctgtaattgttccttcccccatcacaggcctgaagtgggaggagagttgctacagctgtgatttctcctgaggcaaaaagatttgcagccagaaccagcttggcaatgtggaactggtctgtgcatatcacagctgggtgccctatcctgttcccctgagatcctgcagtggaccccttccagttcactcaaggcagagctccaggcattgagagcaatttcttggctggaacagcagcctgagcttccccaccctttctgggcatagattgtggtgcagtgggaccctctgctccatccacaagcagaaataaaggtaacctatagagtgggagaaagtagttgcaaactgcatatgacaaaggtctaatatccagaatttatagtgaacctaagcaaatcaataagtgaaaaacaacctcattaaaaagtgggcaaaatacatgaatagatacttctcaaaagaagacatacaagtggccgagaaacatcaaaaaatgttcaacatcaccagccatcaccagagaaatgcacatgaaaaccacagtgagataccatcctacactatttagaatgactattaaaaagtaaaaaaacaaaacatactggcaaggcttcagagaaaagggaatgcctaaacactattggtagaaatgtaaattagttccgccactgtggaaagcattttgacgatttctcaaaaaatttaaaacagagctaaaatttgacccagcaatcccatgattgcgtatatacctaaaggaaaataaatcatcctaccaaaaagacacatgaactcgtatgttttcgcagtggtatttacaacagcaaagacatggaatcaactcaggtgccctaacagtggactgaataaagaaaatgtggtacatacacactgtggaatactacggagccataaaaaataaaatcatgtcctttgcgcaacatggatatagctgcaggccatcatcctaagctaatttaagcaggaagagaaaaccaaatgccacatgttttcacttataagtggcagctaaacattaggtactcatgtacataaaaatagcaacaaatgggaactagggactactggagaagggaaagtaggaggcagacaagagttgaaaaactacctattgggtattatgcttagtacctggttgatggggccaattttaccccatatctcagcatcatgcaatgtatccagataacaaaccttcatatgtacccttgaatctaaaataaaagttgaaattatgtaaaatacaaaaacagattacaagaatggattttaaaagttgacacttaacgcttttctaaagatgcaatttaagtagaaaattccagatagattggaagtaaatgaatggagaaagacataatcagcaagcataagaaggccacaatggctatgttaatatcagacaagtagacttcaagacaaaggatgttatcaaagataaagaagagcattttcaaatgatgaaaggatcaacacaaaagaaaacaaagcaataataaatttgtttgttcctaacctgcaagaacgtgttgaacctgaaaaaaaaaaaaaagcaaaaattgacagagaaacagaaaatttgacaagcacaatgggagattttaacatcaatctcttggtaaatgattatacaataaaaagagaatcaatgaaggtaaagtttctgaacaagcaccttaaactaattaaaagttttagaatatgatacttaaatacccagtttatacctggtttcaaatgcatatattacaacaagtgccctatcctggcacaaaaaatagtgttaaattatacttcaaaagattgaaatgacacagagtatattcttagattaaaataaaattgggaatcgatagcaaaaagttgtttaagaaaacttcaatgattgggaaatttaatagtatattttaagaatttatatatagagagagaaaaatacaacttatcaaaatctatgtgataaagtaaaagtagcacttagaggaaagtttatagttttaaatgtgttaatttgaaataaggaaatgtatcaaatcagtgacctgaaaatccacactataaaggcagaataagaaagagcaatccagtgtaataagaaagagcaatccagtgtaataagaaagcctgacttgtaaaaactgtagtaaagctcaataagctggactgatttacattcccacttatagtatgtaagtgttttcttttcactacagcctcaccagcatctgttattttttgactttttaataatagtcattctgactggcgtgagatggtatcttattgtggttttgattttttgatttgcatttctctaatgatgagttatgttgagcatttgtatgtttgtaggcaattcgtatgtcttattttgaaaaatgttcatgtcatttgccatttttaatggtgttgtttattttttgcttgttgatttgtttatgttccctttagattctgcatagcatcaaacgcatagttttgcaatatcttcttccattctgtaggtagtctgtttactctgttgatagcttatttttaatttttaaaaattatttaaaaattttggtgggaacacaaaagatatatagcatatatttatggggaacatgagatgttttgatacaggcatgtaatgtgaaataagtacatcacggagaatggggtaaccatcctctcaagcatttatcctttgagttacaaacaatccaattacataatttattttaaaatatagaattaagttattgactacagtcaccctattgtgctgtaaaaattcattgttttttttttttggtacacattaaccatctccacctccccctgatttccccactacccttcccagcctccagtaaactttatatactctctatttccatgagttcaattgttttgatttttaggttccaaaagtaaatgagagcatgtgatgtttgtctttctatgcttggctaattttacttaacgtaatgatctccggttacatctatgttattaaaaatgactggatctcattcttttttatggctgaatagtatgccattgtgtatatgtaccacatttccttcatcctttcatctgctgatggacacttaggttgcttccaagtcttagctactgcaaacagtgctgcaacaaacatgggagtgtagatatctcttagatatactgatttcctttttcttttgggtatatacccagcagtaggattgctagatgatgtggtagctctacttttagttttttgaggaaactccaaactgttctccatagtttattataatacattttcatcaacagtgtacacggtttcccttttctcctcatccccaccagcattgttattgcctgtcttttggatataagccattttaactggggtgagatgctacctcattatagttttgatttgcatttctctgatgatcaatgatgttgagcactttttcatatggctcattgccatttatatgtcttctttggagaaatgtctattcaaatctattgcccattttttgattggattattaaatatttttcctatagagtttgagcttcttatatgttctggctattaatctcttgtcagaggggtagtttgaaaatattttctcccattatgtgagttgtctctttactttgttaattgcgtccttttctgtgcagaagctttttaacttaatgtgattccatttgcccatctttgctttggttgcctgtgcttgttaggtattgctcaacaaatctttgcccagatctatgtcctggagatttccctcaatgttttcttgtagtagttgcgtaattcaaggtgttagatttaaatctttattttgatttgatttttgtacatggtgagagattggtatctaatttcgttcttttgcatatggatatcaaattttcccagcaccatttattgaagagactgtctttccccaatgtgtgtttttagcacccttgtcaaaaattacttcactttaggtgtgtggacttatttctgggttctctattctgttcaatttgtttgtgtctgtttttatgccagtaccatgctgttttggttaccatagctttgtagcagaagttgaagtcagataacgtgattcctctagttatttttatttttgcttaggacagctttggctgttctgggtctttgtggttccatataaattttaggattgttttttctatttctgtaaagaatgtcgttggtactttgatagggattgctttgaatccctagattgctttgggtagtatggatattttaataatactgattcttccaatccatgaacatggcatatctttccaatttttgctgtctgcctcactttcctttctcagagttttatagtttttattatagtgatctttcacttctttggttaattcctaggtatttgattttatctttggctattgtaaatcagattactttttaaatttctgtttcacatggttcacttttgtcatatagaaatgctattgaattttgtatgttgcttttgtatccaactttactgaatttataatttctaatagttttcttgtggggtctttaggtttttccaaatataagattaagtcaccaggaaacaaggacagtttgactttttcctttccaatttggatgccctttatatgtttctcttgtctgacccctcgagctaggactttcgtacaatcttgaataacagtggtggcagtgggcatccttgttgtgttgctgatataaaaggagagactttcagtttttcctcattcagtatgatactagctgtgggtcttacctgtatgctttttatgatattgaggtatgttccttctgtccccagtttttgaagaatttttatcatgaagggatgttgaataatattaaatgctttttcagcatcggttaaaatgatcacatggttcttatccttaattcttttgatatgatatatcacactgattgatttgcatatgatgaaccatcctttaatcccagggataaatcccacttggtcctgatgaatgatctttctaatgtattgttgaatttggtttgctagtgttctgttgaggatttttacatcaatactcatcagatatattggcaggtagttttcttttcttgatgtgtccttgtctggttttgatatcagggtaatattacccttataggatgagttaggaaggattctcttctctgtttttcaaaataatttgagtaggattggtatcagttcttctttaagtgtttggtagaattcagcagtgaagccatcaggtcctgggcttttctttactggaagacattttattatggctttgatcatgttacttgttattggtctgttcaggttttggattttttcctggttccatcttggtaggctgtatgtatttagaaatttgtcaatttcttctagattttccaatttattgccatatagttgctcatagtagccagtaatgatacttcaaatttctgcagtatcagttgtaatgtcacttttttcatttctaattttatttatttgcctcttctctcttttttcgtagtctggctaaaggtttgtcaatttcgttcaactttttaaaaaaccaactttgtattttgttgatattttgtatttcattgatattttgtaattttttcattttatttgtatttatttctgctctgatctttattatttcttttcttctattagatttgggttcagtttgcccttgcttttctagttctttaagatgcatcattagattgtttatttgaagtttttttctcttttttgatgtagacacttatagctatcaccttccctctggttactgcttttgctgtattccttaggttttggtatgtcgtgtttccattatcagttgtttcgagaaattttttaatttccttattaatttcttcattaacccactggtcattctggagaatattgcttaatttccatgtatttgtataattttctaaattcctcttattaatttctagttttattctactgtggtcggagaagatgcttgatattttaatttttttgaaagttttaagacttgttttggccaggcgcagtggctcatgcctgtaatcccagcactttgggaggcaggcggatcaccaggtcaggagatagagaccatcctggctaacacggtgaaaccccgtctctactaaaaatacaaaaaaattagccaggcatggtggcgagcgtctgcagtcccagctacttgggaggctgaggcaggagaatggcatgagcccgggaggtgggggttgcagtgagtggagatcgcgccactgcactccagcctgggcgacagagcgagacttcgtctcaaaaaaaaaaaaaaaaaaaaaagacttgctttgctttgtgaccatacatatgatctatctttgagaataatttttctgctgagaaaaaaaaaatgtgcattcttcagcttttggatgaaatgttctgtagatatctatgacatccatttggtctgtagtacagattaagtctgatgtttcattgttaattttctgtctggaagatgtatccagtgctgaaagtgaagtgctgaagtttccagctttcattgtattggggcccatctctctcttctgctctaataatattccctttatatatttgagtgctcttgtgttggatgcgtgtatatttaaaattgttataccctcttactgaattgactataatgaccttctttgtctctagagtttttgtcttgaactttattttctctgatataagtatagtgaatcctgctcttttttggtttccattgcatggaatatctttttccatccctttattttcattctatgtgtgtctttatatctgaagtgtgtttcttgtaggtgacagatcaatgggttttgtgtgtttttttaatctcttcagccactctatgtcttttgattgaagagtttagtccattcacattcaatgttattattgataaataaagacttattcctaccattttgttatttgttttctggttcttttgtggtgttcccttttttctttcgcttatttctcttttttttctattgaagataattttctctggtgatatgatttcatttcttaatttttattttttgtgtattaattgtatgttttttggtttgaagttatcacaaggcttgcaaatactatcttataacccattagtttcatctgataacaacttaacattatttgcatcaccaaacaaataagcaaaaggaaaaactaataaaaaatgcaccttaacttcatgcccatactttttcagtttttgttgtttttgttcatatattcatatactattgtgctgactatgtcttgaaaagttgttgtagttcttatttttaattggttcattgtttagtctttccacttaggtaagagtagtttacacagaacagttacagtgttataatattctgtgtttttctgtgtatttactgttaccagttagtttgtacctttgggtgagtatttcttgctcattaatttccttttctttctagttgatgtatttcctttaacatttcttataggatgggtcttgtattgatgaaattcctcagcttttgtttttctgggagtctttatttctccttcatgtttgaaggatagtttcaccagatatactattccaaggtaaaagtttttttttttttttgtttgtttgtttttgttcagcactttaatatgtaatgccactctctcctgacctgtaagatttcaactgaaaagtctgctgccagatgtactggagctccattgcatgttatttgtttcttttctcttgctgctcttaggatcctttctttatccttgacctttgggaatttgattatttaatgccttgaggtagtattctttgggttaaatatgcttggtattctataaccttcttgtatttggatattgatatctttctctaggtttgagaagttctctgttattatccctttgaataaactttctacctctatctctttctctacctcctctttaaggccaataactctcagatttgctcttttgaagctattttctagattctgtagccatgcttcattgttttttattctttttcttttgtctcctctgactgtatattttcaaatagactgacttcaagttcactaattcttctgcttgatccattctgctattaaaggaccatgatccattcttcagtatgtcaattgcatttttcagctccagaatttctgcttggttgttgttcattgtttcaatttcttgttaaatttatttgatagaattctgaattccgtctctgtgttatcttgaatttctttgagttttctcaatgcagctattttgaattcactgtctgaaaggtcacatatctctgtttctccagtattggtccctggtgacttatttagctcatttggtgaggttaaattttcctggatggtgttgatgctagtagatgttcttgagtgtctgggcattgaagagttaggtattgtagtattcactgggattatttgtagtcatccttctttctctgttattattcctttgaataaactttctacttctatctctttctctaccttctctttaaggtaaataacaatcagatttgctcttttgaggctattttctatattctgtaggcatgcttcattgttttttattctttttcttttgtctcctctgtgtattttcaaatagcctatcttcaaggtcactaattctttcttctgcttgatcaattcttctattaaaggactgtgatccattcttcactacaccaactgcatttttcaactccagaatttctgcttggttattttccataatttcaattttgttgttaaacttatttgatagaattctgaattcattctctgcgttatcttgaatttgagttttctcaatgcagtcttcactgtctgggattatttgtagccatccttcttggaaaggctttctagttatttgaaaaaaacctgggcatgtgatctaagttgtatctgctttagggggcacctcaggcccagtaacactatggttcttgaagacttatagagggtactgccttgatagtcttggacaagatatgggagaatcctgtggaggggagatactcttgttcttttcccttgctttctcccaaacatacagagtctctgtctctgttctgggccacctaaaactggaagtggagtgacacaagcacccctgtggccaccaccaccattactgcactgggtcagacctgaaaccagcacagtgctgggtcttgcaaaaggcccactgtaaccactccctggctagtgcttttgttcactcaaggccctggggctctacaacagcagttggaaaagccagctgggcctgtgtctttcccttcaaagcagcgagttcccctgggccctgggtgggcccagaagtaccttcaggggtcagagctagaatcacaaactttagaagtctatctggtattctattgtattgcagctgagcggacactcacaccacaagatgcagtccttctcactcttccttccactttccaaaagaagaggagcctcgcctagtagccactaccgcccctggccatgaggaatactgctggactgccaccgatattcccttaaggcccaaggtgtcttaagtcagcttgtggtaaatgttgactggcctgggactcaccattcattcaaggcagtgggctcccctcaggcccagggcaggtccagaaatgctgttcaggaatcaagtcctgtaaatggggaccccaagagcctatttggtgctctaaccccctgtggtggtcttggtacctaaggtgcaagacaaaatcctctttccttttccctcagctttattaaagcagaaggagctttgctccatagtcatcacatctggtaatatgctgagtctcatctgaagctagcaagtctcagaggctgacctgggtccttgatgtggtatctgggtattgctgctggttattcagggcccaagggcttttcaattagcaggtgatgaatgctagcagaactgggtcatatccttcaagtcagtgggttcccttctggcccaggattgtctagaaattttgtctgggagctagggcctggagtgggtccctcttgactctgaccagtgccctatcctactgtggctgagctggtattcaaggtgcaagacaatgtcctcccaacttttccctctcctctcctcaagcgggaggaaggggtttcttttgaagccatgagctgcgctgcctggggttagaggagaggtaataccatgccccagctggtgtctcagtatgtggtatgcccccacagtccactgtcttcaccctaggactcacctaggagtttagccctaggacttgcctacaagttgcagtccttatggcatagtctgcctttcaagtttacttagagaccaaaagcactttggctctagataatgaggtttgtgggtactcaagttcagacccccaggattggtggttcctctctggctaagggctggttgaaatgctccctctgtcagtgggcatcagctgagtttggtctggttttcctttctgctctaacagaacagcactgaattcacttccttacaagtgctgtgttctttcttccacagcacctagagatactctccaaaccatgttgccactgctggaagagggggagagatggcatcagtgatttaggactagtttttctatctcttcattctctttcaagatatgaagttaaaaccaggtactgtgagtgctcacctgatttttggttgttacaaaagtttattttattttatatttttgtagatagttgttaacttggtgtccttgcagggggaatgactgcagctttctatttcaccatcttgctttaccttctgttgtagtttcttttgctgtgcagaagctctttactttaattaggtcccatttgtctatttttgtgttagttgaagttgcttttggggatttagccaacagcctctttggaaagcagtctggagatttctcagtgaacttaaaatagagctaccattcaacttagtaatcccattactgggtatgtacccaaaggaaaataaattattctaccaaaaatacacgtgcactcatatgtttattactgctttagtcacaatagtaaagtcatggaatcaacacagttgccatcagtggtagatcatataaagaaaatatggtacatacatgccatggaatactacacgcccataaaaaagaacaagatgcaggaacataaaaccaaatacctcactttctcacttttaagtgggggcacatatagatgtaaatatggacacacatagacaaaaacaatttgacactgccaaggtgggggaggggggtgtgggttgaaaaactacctatcaaatgttattctcactacttgggtgatgggatctttaccccaaacctcagcatcatgcagtattttcatgtaacaaacctgcacatataccccaatatctaaaataaaatttgaaataaaaaactcagtaaactagaaaacaggcaaataatacagaagtttaataaagccaaagtgaattctttaaaaagatcaacaaaattgataacccatgaattaaaaattcaaaaagaagagagaacccaatttataggttattactacatgttctatagtcattaagcggaaataagtactttgagtttaagaagaaattaagatgaaatttgaacttaaataggaatattaacaacagcatgaaaacacttccaacaaattatactaagtggttaaatttcttgaaacaccaacaaaacttaagaaatgtgagttaaatagtactaaatctattcaacattctgaatttccagaaggtggtgaattctacaaaacatttaagtgtgctatcaaacaaatgcttcaaaaaataaaaaggtgaacaaatttttccaaactttttatgaagccatcattactgataacaaaaccaaatatattgcaaaaataaatcctgcagaccagtatttctcataaacaaaagtttataaaatattttcaaatagaatccagaaatacctaaagtgaaaccaagtgaccagctgcggtttatcatagaaatgcaaggttggcttaatattaaaaaatcaatcaatcatggaaacagaataaagtacaaaaatcatatgatccttacaatccatgtagaacaagcgtttttttttaaataaatgtctgttcattataaaaattatcagaaaactatcaagagttattaaattgataaaggacatttaagaaaagcttataactagcatacttattggtgaaatactgtacagtatccccctaaaatcaggaacatagtaagggttttcattctatttttttttttccaaccctgcactggagattacagccattgcaaacctgttgtacttctaattctgtctgcatcctggagaacctgcctgatagagttggtataaagattgttttgagaaagcagccagaaaaataaatggttctctctgcctgattgacaatgagtacccccatctagatgctatgtaggacagaaattatccatggcacacaatggcaacgtaatttcttaaactttcacaaggaaaatatttttggacaaaattcccttggagggggatatgatgctgatgtaatgattcaaatctttgaaagggacaaggggagagtgagctaatggaattggttggttgttagtaaattgcatcgaagcccgacagaagtatattgaaaagcttagggcagttaacaatcaattaaaaacttaatacaaaggttattgagcttcttcagaagcttacaaaaggtgtttatctcttgccagagggaagtacgaataactgaagaccaagtcaggatttaaaatcagagttgcctgctgcaaaaatgattgaatgctcaactgaagtgtttgttatgacaaggtcagacctcggatgggtaaacccgggaacaggacagatagaatagggaccactggatgaaggtccttaaagatactggctccataaagttctttgaatcctcagagcttaccagatgcccatttctcccccataaagagctagtactcttcccgtttagaaagacactgcagaggccttcccttgcaaggcaaaaggaaaatctttcattatctatcttcttctctcctcattcctagagttaattacagcataaaaaagccaggcatgtaaatctggtaagatagaaaagagattatcttctccttgcctccaaagaattttggagaattaaccagagtgtatcaacaggagctaggtgaatacccctgaggctagacttggagattgcttgatcaggagagccagaacatagcacttcataaggaatagcttattggcttggagcatgctcatggaatttaggattttaataccacgagaagtaggccaggttatggtgcgaactcttccctagagtggcttctagaagactgaagaacatgatggcctacacagaacagaggtgtcatgtatgaattgctgtggcagatgatggctggaagggtttaaaaggttcatgaaagtgtgtttttcctattgaattgtttgagttccttatatatctggttattaatcccttgtcagatggatagtttgcaaatattttctcatgttcaaaggtttatgtcttcaccttgttgattattttctttgagaagctttttagcttgacataatcccatctgtctatttttgtttctgttgcctgtgcttttaaggtcttccagaaaaaatatttgcctaaaccaatatcctgttgtgtttcttcaagctttttctagtagtttcatagtttcagatcaaagacttaagtcttaagtgcattttgatttgatttttatatatggtgagagatatgggtgctgtgtaactctttttcaaatggtataatgttattatgtgaaaccagaatactcaccagaggattatgtatacaagacagttaggttcttcacatgattatgtctgctggacagtctggaagacacactatttaccaaggccaccaggaatgtgatggtaagagagttgccagcatcatcaaggagattagtgatgcctcttttctgtaggtcagggctgactgcaagggaggttgtttcagagcctctttgcttattaatagcaaagggtatgatgagacctcaaagaagcagaagccaggtgtttatctgccagaagctaggacttctcagctaatgcagtgactggcaaggtaggaatagtgagatttaaccccccaaaaattgtggggtttgtggaacatggtattcctatggataaaatagggtaggcagctaataagggtaatgttaaatattcttgttaaatattgttaaattgtgcaagagaaagcaagaatagatgaactcacggtggttttcccagtaaaaagccatgatttttttacccaaatacgtgaggcagttttcagacccaaaaatcattgactaaagagatggagtgtctgcaggaggaagcctgcaaaaccataacaaatatatatttgcctcaaaagacccatggctatttacttgggtgagtatacataggggaagaatgaatatccagacattttgaggattattagatacaggatttgagttgacattgatatttgaggacaagaagagtggcattgacctatattaaagtagaaagctctgaggaccaagtaataaatgaaattttggcccaaatttggcttacagttggtctactaggtccatatacccagccagtggtcactgaatgcataaatgagattaacaacattggcagttggaacaacttctactatcagtccttgacttaagtggaaatgacaaccatagtggagagggttgtcctctttccattgactaagggacaaataaaatgcaatatcccatcctggtggtatgtgtgttagggaggtgatggcagagattagtggggatgtagaatctcaaggatgcagggctggcattttaatctgtttgtgctgctatagcaaaatacctaaaactgagtaatttataaagaacagaaatttatttctcatgactttagagactggaaatccaatatcaaggcactggcacgtttggtgtttggtgaagtcctggtctctgcttgcaagatagtgcgatattgctacctccttgtggatgtttcctgattggcagataagatgaaaagcaaaaaaaaaaaaaaaaaaaaaaaaaaattgagaagtggctatgctagttctctctagcctttttataaggcactaatccatttatgacttaatcacttcccccaaaggcccaacctcttaataacactgcaatggatatgtttcagcacgaattttggagaggagacacattcaaaccatagctggtaaccaccaatctatctatcttcatgagctacatgcttttttagatctcacatatgagtgagaacatgcagtatttgtctttctatgcttggctcatttcacttaacataatgaacctcttccatccatgttgtggcaaatgatgggattttattcttttttatggctgaataatatttcattgtgtatatataccacattttccttatccattcatccaatgatggacacttaggttgattccatactttggctattgtgaatagcgctgaaaaaaacatgggagtgcaggtatctctatgacatattggtatcttttcttttggatatatacccagtggtagaattactgggttatatggcagttctattttcagttttttgaagaacttgcatactgttttctatactggctctactaatttacatttctactaacagtgaacaagagttcccctttttcctcattctcaccagcatctgttattcatgtctttttgataaaattcattctaactggtgtgggatgatatctcacgtgattttgatttgcatttatccaatgattagtgatgttgagtattttttcatatgcttgttggccatttgcatgtcttttgagaaatgtctattcagatatttgtctatttttaaattagattgtgtttttcctattgaattgagttccttatatatctggttattaatcccttgtcagattgatagtttgcaaatattttctcatgttcaaaaggttatgtcttcaccttgttgattgttttctttgagaagctttttagcttgacataatcccatctgtctatttttgtttctgttgcttgtgcttttaaggtcttccagaaaaaatatttgcctagaccaatatcctggtgtgtttcttcaagctttttctagtagtttcatagtttcaggtcttagacttaagtcttaagtgcattttgatttgatttttatatgtggtgagagatacgggtgctgtgtaactctttttcaaatggtaattcagttttgtcagcaccatttattgaaacaacttccctttcttcattatatgttcttggtgtcttagtaaaaaatgttgtaaatatgttgatttacatctaggtcctctattctattgcattggtctgtgtctctttttaacacgttagactgatttgtttactatagctttgtagtatattttgaagtcaggtagtgtcatgccttcagttattattttttttcttacgattgctttgtctacttagagtctttaatggttccatataaattttaggactttttttttcatttctgtgaagaatgtcattggtattttggttagacagttcactgaatttacatattgctttgggtagtattttaattttaacaatattaattcttccaatccatgaatataagatattcttccactttttgtatgtcctcttgtatttttttcagcagttttttatagtttttttaaaatgagaacatcacatctttggttaagttgattccctattttatattctttgtagctgttttaaataggattacattcttgatttccttttcagatttttggttgttgatgtaaataaatgctattgacttttgtatgttaattctgtatcctgcacttttactgaataagtttatccattctgattttttttttggtggagtttttaattttttctacatataagatcatgtggctgggcgtggtggctcacacctgtaatcccagcactttgggaggccaaggtggttggatcacctgaggttgggagttcgagaccagcctgaccaacatggagaaaccctgtctctactaaaaaaaaaaacatacaaaattagccaggcatggtggtgcatgtctgtaatcccagctacttgggaggctgagacaggagaatcacttgaacttcagaggcagaggttgtagtgagccaagatcatgcctttgcactccagcctgggcaacaagagtgaaactccatctcaaaaaaaaaaaagatcatgttgcctgtgtacaaggttaatttggcttcttcctttccaattttgttgggctttatatctttctcttgcctgtttgctctggtccaaacttttagtattatgttgaataaaagtgatgatgctgtcttattccagatcttagagaaaactctttcaaatatttttcatttagtatgatgttagctgtgggtttgtcatatatggcccttatgattttgaggtatgttccttctatactcagtctgttgaaggtttttgtcattaatatgttgaatcttattgaataagttttcagcatctgttgaaatgatcctatgtttttttgttcttggttccattactgtgatgcaccatgtttactgatttgtgcatatggagccagccttgcatccttagtatgaatcccacttaatcgtggtgaatgatattgttgaatgcagtttgctagtattttgttgataatttttgcatctatgttaatcagtgatattgatgcctgtagtctttattttttgttgttgtaaccttgtttagtcttattttcagggtaatgttagcctcatagaaagaatttgacagcatttctccctcttcattttttttggaacattttgagcagaattggtgtttgtttttctttgaatttggtggaattcagcagtgaatccatcaggtcctgggctttgtttgatgggagactttattatggctttgatctcgtcactcattattggtttgttgaggttttcttttcttcatgttttaatcttggtagattttatgtctctgggagtttatttcttctaggttttccaatttgttggctataattattcgtaatagtttttaatgactctttgtgttcctatggtctcacttgttatgtccccttttttgtttctgattttatttacttgggtcttctctctttttttcttagttcagctaaataatttttttccaaaaatcaactttttatttcattgatctttagtattttttagattcaatttcatttatttctgctctaatctttattatttatttcattctactaatttggtttgttttgcttttccattttcttgaggagcactgttatagtttatttgaagcctttctgtttttttttaatgtaggtggttattgctataaacttcacatttgtactgtcattgctgtatcccatagatcttggtatgttgtatttgttttcatgtgtgtgtgtgtgtgtgtgtgtgtgtgtgcgtgtctagcttcatttactcaacataatgtttattaaatacatctatattgttacagatatcaatcattattttattgccttgaatattttattatataaatatatcacaatgtattcattctcatgataatggacatttgagtatttctcaagctttgttattataaataaatctgctaagaactttcttgtatgtgtcttttggtggatggacgtatacactcatttttcttgaatatgtagctatgagtgaaattgcaagatccaaggatatatatatgtttagcttttgtagatacttccacataatttcctgatttttatgttgtaaagccagctttatttttgtcagtttttgcatggtatattattttccattcttttactttcaaaaagtctgcatattaatatttaaagtatattacaaacagcacatagctgggttttgggtttttaatttttcaaattcagtcttctattttttctcttctgtacacctaaagtctttgtttttttttttttgttttttttttttgtttgttttttttgagaccgggggattcactgcgttgcccaggcaggtatcaaaactcctgggctcaaacaatccccccacctcagcctctcaaatagccaggaccacagcatgtgccatcaggccagcacacaaacacacacagctttttagttggaatgcagtatatattgtctagttacatctaatgtaattactcatatagttaggtttaagcttacatcttgttatttgttttctatttgctccaattattctttatttctttattactactttttcatcttatgataattgtaaatatttatgtttttcaattttatcgtctctgctagttttttaattatatctttttacgttactgttttagtggctaccctagagattacaataggtatcgctgatttattgtaatctaacttaaattggtatatttatcacttcctgaacaacgctagagcctttcaacaattcagttccatttacctgtcctgccatttgggttactgttgttatatattttccttgtgtgtatattctagaccctacaagacatggtgattgcctaaaacaatcaattttcttcatatttattgtactcacacatttacccttgcaagtgtccttcatttgtttttacacttatgcgattctttgtagaatcatttttcttcaacccgaaaaactcccttcactgtgctgaagataaattgttcagtttttgtttgtctgaaaacatctttattttgccttccttttagatatatttttaccggttatataattctaggactgcaaatgtttcttctgtttttcaactttttaaacatgccattccatgtgttctggcttccacagtttctattgaaaaatcagacgtgctgggtgcagtggctgacacctgtaatcccagcactttgggaagccgaggcgggtggatcatttgaagtcgggagttcgagaccagcctaacatggtgaaaccctgtctctaccaaatacaaaaaaattagctgggtgggtggtgcatccctgtaatcccagctacttgggaggctgaggcaggagaatcacttcaacccgaagggggacggaggttgcagtgagcagagattgtgccattgcactgcagcctaggcaaaaaaataaaactccatctcaaaaaaaaaaaaaaaaaaaggaaagaaagaaagaaagaaaaatcagacattattcttatgttgcccttttaaatacaatgtcaattttctctatcctactgttaaggtttttatctttacctttgatttttagtgatctaactacatgaaaaactgaggtgtggctttctttgtatttgtcccacttagggtttgctgaactccttgaatctggagatggagtcattcatcagattggaaagttttcagctattatattttcaaatattgcttctgcccattacctttatcctctgctgctagaaccaattacacatctctgttatattccattcttttccattttttgcaagtatgtgtgagtcaatttggatattttctattgacctatccttgaattcactaattctgtctcctgctgtgtcatccgatttgctgttaaacccattcagagttgtgttccagacgtccatttgtgtctcctttcaaattccagttctctgttgaaattctccatcttttcatctactttccatcttttcctctattgtttaaaaaataatcctaattatttaaagttcttatctgtgaacttaaacaattggatcatctttgtttctgcttctattgtttgcttttttctcttgattattagtcacattttcctttctcttcatatgtctcctcatttttattgtatactggccatatacagtaactgtatatactgagttagatgttttctgccagaaagcttttcctgtttttctgtcaggcagagaagattaaagttgatgacctcaatccatttggatttaatccgggtcatgggtaagtgcaactttgtcagattcagcccaactcttaatatcagtaatctccgaagtgaaatctgacatgtatttattgcagaccactccctttggcaatctgtctcccaggtactgagagattgcaggagatttcactctgccttatcagctcagcaccaaaccttccatgctagccgagttctcaacaaatgttgtatgagagaaaacagccatttgtttgatactccatcatgttccaatctgtcaaaccgattggcctgcccatgaacatttctactggtttctccttccctcagtagaattcctctgcctaggtaatgtctgaacctcatctcagactctgactcagcaaatttcctaatagacagcaacctcaatcaatttacctaattgggactattcattctctgtaattttagttcatctagtctttttttcttcacagtttcttcacagttttttgataaccttatttgataacagttatttgataactttatttgatagttatttgataactttaaaaagtatatttatgtgtgtaactttaaaaagtatatatatgtgtgtgtgtgtgtacacacatgtgtgtgtaggttttcactctgtcccccaggctggagtgctgtgatatgaccatagctcattgtaaccttgaaaccttggacttaagtgatcctctcgccttaagctgggactgagtggctgggactacagtcatcagtcatgcatcactgcgcccagctatctattttcatttgtttcagaaaaattgttaattcccttagtttcttcattagcccattggttgttcaggagcatgttgtttattccttgtgttggagtaatttctggggttcctctagttattgattttttagctttatttcattgtggtcagaaaagatacttgatataatatctactctttaaaatttgatgagacttattttgtcgctaaaatgtagtctgttttggagaatattccatgtgccgatgaaaagaatttgtattctgcagcagttaacatgaaatgctcagtaaatgtcagttaggcctatttggtctagtatgtagtttaactcagaggttgctttgttgattttctgcctaatgatctgtctattactgagagtggagtgttgaagtcgcctactatattgtattgcagtctattcctccctttagatctagtgatgtttgctttatatgcttgggagctctggtgttgagtgcatagatgtttataattgttatatccgctggctatattgacctctttatcattatatagtaaccttctttgtctcttcttacagtcttagtcttgtagtcattttatctcatgtatggagttaagcctatttatttggttttcactcacatggaacatctttttctgtcctttcactttttggtttatgtgtgtattttttttttttttaagagatggagtctcactctgtcacccaggctggagtgcaatggtgtgatctcagctcactgcaaccttcacctccctggttcaagtgattctcatgtctcagcctccaagtagctgggactacaggcatgtaccaccacgcctgatcaatttttatatttttagtagagacaggttttgccatgttggtcaggctggtcttgaactcctgacctcaagtgatccacctgcctcagcctcccaatgtgctggggttgcaggcatgagccactgtggcctgcctatgtgtgtctttaaggtaaggtggatttcttgtaggcagcatatagttgcatcttgtaaattagtggttaccaaacaccaggaagggtaggaaagagatgtggatgaagaaaggttgattaatgtgtatctatacactcatatagaagaaataagacctggtgtttgatagatcagtagggtaactataattaacattaattggttgtacatttcaaaatagctagaagagaatgattagaatataactagcaaaaatgaaaaataactatttaaggtgatgaatatcctaattatcctaactggattatatgaatatatcaaattatcacatgtaatctgaaaatatatatatatatataaaatagattatatacatatcaatttaaaaaagcataatccacatatcagctgattgttaatttagggccaccacagatggttgaacagattgagtacatcactattttgacttctactagaaagtgagtagtacttccccaaagagtacaccacctagacaaatacacccagtgtcctcctctcatagctcctgtgcccaggagttctgtctccatgttttgtttacatctaccagaacatggaacacagcacatcttcaaacactcaaatattcactcacgcaaaattgttagtaccatacattttactgaagattttacggaaaagatagcaaaagaagtttatatcatataccttcagtgaacattttaaaaactaccccttagacatttctattattctgcatatactcttctgtttttccactagtgggcgtcttttttctccatttttcctagttacacagattttcctccttttcagaattctgattttttgaaccactgtgacaatgcattgaaaaaggaagtaaacatcctgaagccaccatggaaagtctttattacatcaaagaggtacagatagtgtttgaaggttttcagagataaagttggaatgctagcaagacaaatcagcaccaaaaactatttatatagataaactataaatatctatacttatgaattggctcaagtgacacaatatgataatgcctataccacacattataaacccttccttgctgaattgataaagtgtggttccctacctgtctgaaaccttcagagctcataaaatgctaacagtagcatacgcgagtcctgagaattcccaccaagaaaacaggattgggctggcagaactctattacgggatagaatcgaggcttgtcctccccactgaaacatgggcagataattttagggttaatctccggacaagtgcaatttgtacctgaggtcaactgaggggtggcaggtgagaatcaatatgaggcaggatcagctaatttcccagccgataaatccaaagagagccctatcatatctaatgcttttcaggcagctgctatataggttaatgacatgcgaaggggaagactgaggagcgtcttttcttttactgcaacaaaggcagaaatccagtgaaagtggaatcacccttcagctcgaaactactgagaagcccagtaaggtctttggaccatttgatgaagcagtgttcagtcaaaccctggagctctgcacagaaggagagagctgtatgttggtttaaacccacactacattgtgtttgccacttattcctctgacaaagttacgttagtgcacaacagaaaagcccagcaaaatataccatcttgggttgattaaaccgtgtgctgataattagtgcaaatatgcagaaatattttattaggccttttagttacccatgaggctagttctagctaagggaaacttctctttctccttttaactgtgttcagatgacaatgaaccatgtctggcaggcagaggagacactgcaaacttgtttaaagaagaacacagttgcagactagaggaacatgagtgacaaagctctccctagcccttccagttagttcacatagctgcattgcagatttggactcactgacatacaagaatattagaagtatcctcagtccatgaagagcaaggctcttcttgttagaatgcaatttgttggccgcttagaatccagtaattctttccaaagatgttggctgcgtccacaggatatattctttactgctctgtgttttattctttgcttctcaaaacggcattttctctccagttctgtgggtctctgaggggtttttgtttggtcagtattgcatttaaggcagccaaagtagtaatgttattagttccaaatagcagaaaatatttttttttgattatgtgagtagtgctagctcattgttgaacatctccaaggtataaaagagtattctaaaagatgcttatattcctactgccttgagataaataaatacaatcatttttttcttgtgtaatttgtagtaattggaaatgggatagaaactacagacacatagagaaacaaccacaatgtcagcagagcgctagaagagggatcagtaacctctcagctgaagaaacttagatcctttctactcaaagtggggtctatagaccagcagcattggtatcaccatgagattgtgggaaatgaagaatcttaggccaattctcagacttaatgaatcagaatctacattttcacaagattcccaggtgaatctcaccttaaagtttgggaagcactgctctagatgatctggtggccacagctgtattggatcctgaaaaatcttccttctgcctttgtgaggcctgatggtatgctctgtcttcctgtatttccatgaatcctggttcaagttcaagaagttaatcagcagaagagctgggattcaaagaggtgtttgcctctgtagtccatctaattaactatgatattatatttctagtccttctacccaggaacacacaatgtttttccattaattgaagtcttccattaggtgttacaataaagttttattaatttttcaaaataaagcatagcagattgtattacctattgtaggtccatttaaataattgctttggctcctgaagaaaccaggtggattctggagattgactgtagacttcaatacaaacttatccaagtggttctgatcatgcctgctatgttagacatggtatctgttgctagatcaaattaatatgactcaaggattatgatatgcattattttctattccagtgatgaaaaaggaggacacgcagttcacatgtacacggaacaaacaaaaaatacacatttagtcttttgtcccaagttatattaactctcccatggtttaatattcttagagaacaaaaacatgaatcataaaataaaaaaatagaataaactggatgttatcaaaattaaaaaaactttaattctttcaaagataatatcaagaaaatgaaaacttgagatgcagaatgcaagaaaatattcacaataatatatctgacaaagatcttatatccagcatatatgcaaaactcctatatcagtaacaagataaacacttccttacccaagaaaaattagatataatatttaaaatgacaacccaccaaaaaagctgcacttgtgtgaataaacaaaaagtacatgaagagatgctcaacatcattagtcatcagtgaaatgctaattaaaaccacgagatagcactacacacctattagaaaactgataataccaattgctgttgatgttgcagagaaattggaacaatcatacatggctgatgcaaatatgaaatcatataaccaccttggaaaacttgcaaactcttgaaatattaaacatgcatgtaacatataggccaaataattccactcctaggtattttcccaaaagaaatgaaaacatatgtctacacaaagcttgttcctaaatgtttatggtagctttatttgtattagcatcaaactgggacaccacttgtttgacacacacagacaacactaatctacagagacaagaatagactattggttgcctggggctggattgggataggggaatagattacaaagagaccttgaagaaatttgagacagtgataggaatgttctgatattcattatagtgatgtttatacagttttatttgcctgtcaaaactcattgaattacactttttaaatgaacgcactttattgtacataaattataactcaaaatttattttaaaaaattttcagcaaatttccacatcttaattcagcctcatagccagttgcccttgtctcaactcctggcactcccccatataaaacatacatagagacttgtattttccaactgcatcacgctgtttgcacttcaatgtccttgtgcatcctgttcctgctgtctagacattctaatctccttttctctaccaaaagaacttttaccaattctttaagcatcagctcatgcagtgtcttctccaggaaatcttccatggtttcctagcgtgagttgcatttatctcctgtgcccctgcagtgccctgcacacagctctcatgtcgcacgctgagttgttaatgttgccttacttctcagtcttagattttacattctgtgacattgtagtcatctttctatcttcagtgtctggcagtgagtagatattcagatatttaacaaacatttgctgaatatactattatatgtaaagaatactgtttctggcatttacattgttctcgtttgtaagttcagagaaatggggcaatctaagaaacttctggagggaggggcagctatgtatgtgtgaatattacgtaaagtaaggggattgatttctcccatagactttcttcctgtactgtagaacccctccatgcttgataaaaacatgaaatagataaaacctaactatggttctcttcttgggggcactgtcttttcaatgaatactaaatctcaagtggcctacggttcttcagagcactctttcatcatgctgaaatatgtctggcctcctgagtcttctctccccaggcattacttttatttctcctgtttcttggctatcacattatgcaccatccttttctattcttgttcgaaagctcatgctcttctttaaaaatctaggttgtataaaaaataatactgaaattttaggactgatacatggaaagagtggtatttcattaggctgataattgaagtagtttggaacctatcactaatacaatttttaagaacttaacagttgcattgaatggtagtagcacatacttcttcatgccaatcaggttcgttttttttttgctagacatgacaaactctagactttcaggctttattctagaagagacaatggttgtagaaggaaaatatgttaaaattgtatcttccctgtgccttttacccataaacttaaaatgatctctcttctttttcttgacacatgtgatttgtttctctaactggtagcctctgtttttctctctccttccacacctctctgcctttcctctttcttttctactccgcctcccaccatcatccttgagagcatcctaataaagagctcttaaagattctgatgtacaccactttctgttgtgtggctggctccttttcaatatttctttctgaaaagtaaaataaaagcaaccacagtaatgattgttaagaataacaatactaatgattagtaacaataaaaacaataatgttagttttatttaccttcttgaagggatgatgtgcattctacagctcattattttataaagtgctcttttgatgaagcattgtaaaacacagaaattgttcctaccattttgattagcattagagtaaagcaacacttgagacaaacagggatgtgtgattgtttactctttttgtattgagaaaataatgcatatgagttgattctagaataatactgtgttcagatcatatcagtgactcattttttccctttaaaaatagttacagatggaaagtttaaagcctttattttctagggctgttttgaatgtttcttaagcaactcaattctctatatggtaaatacacacaaaaagtcctggtattgtttttcgcagtattcagtgcaggaccatctgtcaatctatcactcccacttgtgacagaatatggaaaggtcaatggagttgtcatttttacaacaaacttgaacaacgcttttgcattcattaaatttagaatctctcccaactaataaatgcataaactccttttaaaacaaagataaaatatgcaatggaaataccttcacttacactacacattttttaggatgttgaaagttatgtgtttcatgctccatgaaagaattctattttctcaaaagtacaatggacttcattatagagataataggtgaccacttaacctgcccaagctcacaaatatgcaagatctgtttgcagcagtgaaattatttctaaattaagcaaaggaggaaaatgtggcaccaaaataaattacttttctggccatcttgaattcagcagctgaaaaatcctcatacataagatcaagatgaaaaggaaataggctttacctgaagcattgattactcagcccacctgaagattaacctggggattcatttgaaggagaagaagaatctcgacgagtaggttagatgaaagggttttaggaggccaatgagattacatgggtttagtcacaggcaaatagacaggggtgacacatctgtgagggaataacaataggggcttgtctaggacaaagaggaagaaatgcagtcagagactcagctgtcttattggggtacaataaatataaattcattaaaggcaggggaatacagggcaagtgacgatttaatactaaaggttaccaattcacttgtcaagcctccatcaactctgcgtatttgaaggtgggttattcctagttggaggttaaattttatgatatactaatgcacattatagctaatttgtatttaattaaaataacaggtacatgcttattcataatgcatttaaattttttaaagtaaaagaaatcacctattatactcaggcattatttcttttacattgaagaataaaaactgaagctatcttaacatttaatattcaatttgttctattctatttacttaactatcctattgtctgagattttttcattggcattttctgcttcaatgagtaggggacaagtactaacagaagttcctacattttggaagaatgtcagcagtctccttagctccccaggataaattaatttttcctctctttgtccttgttttaaattcagagccttgttcttctcttcgtgaattatgtcactgagcactgagaagctgtgttgcttttgctcttagtcatgtttcattcgccaatatacactaagtgcctaggtgctgctctaggttctcctgagagaatagatcaaggagattctatctaaagaggggaagccaaaattaaacactaagcacattttaaatatttctatctgcaatggagacagcaaaagggagtgatgtggggaagtgactggatcgggggtgggaagtctttagatagagagactaagatttctccaaagaagtaacatttgggttgacttttccaggcacccaaaagagcaagtgtaaaggaccaaaggtgggatgacttgggtttgaccaaagacagagaaaaggccaatggagttaaataaaggggttagtaagactgggacaatgtcagaaatgcaggggtcagatcttgaaagtgctcatagggcataaaaaatttacattttattttaagcacagtggaaacaccatacgttgttgctgttgtggaggtagtgcttagcataattaaaactgtggtctaatttttttaaatgatctaattttttaaaaaagatcgagtggagaaaggcaagaatagaagcagggagatatactggaagtgactgcgtgattcaagggaaggacaatggaagtctgcatgataggagataaaattaaatcaagcagggatctcttgagtgggtttctaccacctgaaagcagagtaggtacttatctacaaaatttagttttaatgttcatagttacggtcaatgagtactttctcttacagattacaatggataaaacaacacctaactttagttgtctgttgcttggactaaattctcccttttgaaatgaaaataattttctgagaaatgctatattaaaacattaaaatagttaagcatttcttgcatatcatggaagatcttcaccagaaaaaacagctggtttagaagggcaagaaatacacagaggaacacatctaagaatgtagcattgcatgttcttgatccattgatttgcagagaccacttatattagatttttctgcatcctctccttacagcattacatcttggttactgagacagtatttgttatatttgttgacaaatattgctgcactgtcacctcagtgtaacagtccaattctgccatgtgatgaacacacatggctttttcaagaggcctacttttggatgttcaaatttacacatgatgaaacactgaattcttttcttaagggcaatcaaagacaatgatgtttttgggagattggtttaagttgaatccctttgagtctcagcatataatattggccaacctgccatattttaagcaaagtgtcatattttatgaggcacagcttgcaagaacaaattccacagtgagagatgcaaacatcagtcaaaagcaaggattctagtatcactaagcatctattaagggcaggcatgcgaggtaccctggtgaatataaggccttagggagactacatatagatgtataaaattgcaaaagatgttacatatgattttgtaaaatgggtgatgcaaatgttgctaaaagggttcagaagaattcaggggagtcaggggtgattgtaagagggtcagacatactttcctaagaaccgtagtgctttaactggattccaaagattgaagttgttttcccagagaaggatgataaagaagcatgacaaatgaaccatcaaaattaacaaaactcttggactctacagagtaaatagtaggaaaagcaatatggtggatcctacagacattcctggagggaaagtttgagtccctagtgcatttaggaagctctttaaaactaaaaaatataccaagcctatacctggacttctagaaagagcatgatagaagcatcctgttaacattgtttttgtcttccttgattagtaacaaagtaagtgcacataacaacaacaggttcctgcaagctgaagaatgtcaaggtaaggtgaaaggaaggaaacattgatcacagcagttatatgttagaaagtatgggtactgaaagtaatggcttatctttgttttccttctcttgttaattgtttggattctaagttacctaaaagaaatagacagttggccaggcacggtggctcatgcctgtaatcccagcactttgagaggccgaggtgggtggatcacgaggtcaggagattgagaccatcgtggccaacatggtgaaaccctgtctctactaaagtagaacaaattagctgggcgcgtctgtagtcccagctactcaggaggctgaagcaggggaattgcttaaacccaggaggcagaggttgcagtgagccaagatcacaccactgcactccggcctggtgacacagcaagactccatctaaaaaaaaaaaaggaaaaaagaaaaagaaaaaattagacagttcatgtaattacactgttaaagagaatcacaaacactttttagcttgtggcataattattcaagcatagatgcaaaatgcaaaaaagtacatattttaaattgtgttttgctgactatgtttggcagtacatttttatttttagcctagtataaattacattcttttcaggatagcttcttgttgtagtctataatggggaatgggtgacaaatggtcagcttactccttatcagaatggatatcttttattttaagtctttcatagatttttttttatttgaacagagcacatataatcaagtttttattctagtctttaaaaaacaaccaatgtaaaactgtattggggcaatttagataaagaaattatattctggtgaaacaaaaacacatactaatattgttttaatgtttgagaattagaagtgttaattgctattttataaaacacgttcaaaatatcactattctaaaccagaaagtgtttgttggttttactatgtggaattcaactgggaagactacattggttaaccaaaaataactcatatgtttcatgactttataaaagaatatattactttaggagaatgttaaatgcgtacagcaacagtagcaagcaggagcaagtagatataatataggtagcttattttcatttttatataatgtatttttggttttaccaaaaccaaaataaaataatacctcctcttttaggagtagcagttgtacttatgaaaagaaacataaaacaaagtaatagatttggagagatgatgtaactctaaggaatagacaatatatacagtttttctttgttatatatatggatttatatttcaatagtgagatttaaagaatctagtggattttattcttattttttctggaaagaaattgatttacatttttaaaaattatggcattcaaaaatttaatcttttttgaaacacaacaatgcactctgttgaatatttaattgaatatggtccctactgattgagtcttgaataattgctaattggaatgaattatgaaaggaaaacatgtatgtacactatccctatcatttcaacaaagaaaatacaaatttcagtgagaatcaaaatgtgtttgatattagccaatacaatcttcccttttcacttttttggctgctgtaatatacttcatggaggagtactgatgaataaaacaatttcttctattctttttataaactcttgttaccctaactccatgattctttgttcatgaacctggtgtaaaatatctgatgaccctgaaacagatatggaaccatcacatactaatcatgagtgcagtgatgacaactatgccaaaggaattcgctgaagataattcttctcaatgtaactgtccatccacagttctgcatgatctggagagatctccctaatgaaatgatttcatttgaactgagtgacatgggctcatgtatgagctaagggttgaagtagataataattatagctaatatttggtggttgtttaatatgtgatgagtactgttataaaacatacatacatacacacacactcgtttaatgttaacaagcttatggtataggtgttattactaaccccactctacagatgagaaaactgagcacacctagattaaatactttgcccaatttcacacagtattaagtagcagaggtagacctgaaacccattccatctggctgcaaagccaatgttgctaaccaggatgctactttgactcttttggtgagctctaggctccttctatttccaagattatgaaaccacaatacttgccttctccttcaataactcaatgaagaagtatctctcaataataaaaggatatgacattgagaatatgtctttatccatgtaggcctggaaacatatctagccaataatgagggtttgaaaaatgagaaagagatgacattgcaacttttttagtaaattactttagttaggatgtgttagttttcaataacccaaggtaaggatgattcattatcacacttcagggcgacccatactaagaaaatatttgtatgtttgttggtgtctgatatgaatcaaaatatttataaagttaagtactttagtgtaaacgcctataaatttgaaactaggtgttgacttcatcactgtgaacattatcaaattactagtaatataacaacgttacagatttaaaattttcttgagctatggcttcaataacattttcatttattggagtttatgtaacatcttcagaagctttaaaaaataatttgcaagcagcttggaaatgttctagcatttcagtgaggtaaaaagcatatatatatgtgtgtgtgtgtatgtgtgtgtgtgtgtgtgtgtgtgggtctgcataactaaaacaagtagtatgttaatgtcactgaataaatttgaattagggtgaagaatacttcttatacaaatgcttttcatagcacttctcttgaaccacagtaaaaacctatattaggactatcctcaagttagcttctctaatttaccttcttaggcagaaagccactaatttgcattaacaattagcagcatgaagaacatcctcatttaaatgacaggcaaagaaaaatgtgccacaagtgataatcatgagaagcaaatgaagagaggaggaaatctgtgagatggcagtgttattaaattggctgttttgatattgaaagagtcatgaaaagaagaaagccctaaaaagtttccaaattatcaagcaacatgatgatgaactaatgtgtatgagatttggaaaacgggagatctttgtcaatcttgttgagaggaattttagttgcatcaaagagatgggatctagattgccagagtttttaggaagtgagaaagaaggtgtagagagtagaggtgactcagattttaattaatcaaatgcacacaaacttgaaaattaaactacagatatataaataactcatgggtcaaagaagaagtcacaagaaaaatttgaaaatattttgaatggaataaaaataaaaacacatctaaatatatgagagagatagctgacagtgcttacagaaatttatagctttaatggaaatataagcaacaaggacatatctcaatcatctgtttctaccatatgaaatttaagaaaagccccaaacaaacagaaagtaataaagatcagaacagaggctgattatggtggctcaagactttaagactgaggcaggaggattggttgagcccaggaggtcaagaccaacctgggcaacatagcaagactgtctttacaaaaaattaaaaaaattagtcatgtgtggtggcatgtggctgtggaccaagctactcaggaggctaaaaaggaaagaccacttcagcctgggaggtggagactgcaatgagccgtgctcgtgccactgaattccaacatgtgtgatggtttaaaaagcgtctcaaaatttaaaaagtatctcagaaaattaaaaataaaagatctgagtggaaatcaatgaaatagaaaatgaaaagagcaatatcagtgaagctaaaacttggttctttgaaatattaacattgataaacctttaactagaatgaccaagaaaattgaggaaaatatttcccaacaaagtactgttagcgagcctagtcctgcaaaatatataaataattatacattatgaccaagtaggactaatctcaagaatgcaaagttagtttaacataaaaaaattaacaaaatattccatgttaatagagtgaaggatgagtactacatggtcattcaaaaggcatggaatggtttctggcaaaatctagcacctattcattaaaaaaactctcaagaaactaggttttaaggggaacttcctcaacctcctaaaggatatctatataaaattatgagctaacatgatatctaatgttacatatgttagtgaaagactgattttttttttctctaagacgagaaccaaggcaagaatgtacctttataccatttttatttaacattacatgggacgcaggggcagaagaaggcataaatgcatccaagttgaaaatgaagagataaaattatcttgattcatagatggcatatttttgcatgtacatttggatttcacaagaaatccaacattattaaaattaataaacaagtttagcatatttgtagggcacaagatcaatttataaaatcattgtgtttctatatactagcaatgtattttcagaaaatgaaattaagccatcccatttacaatagcatcaaaaagaataatatgctgattaataaatgcaacagaagaggttctagactttcatactgaaaactataaatcacttgagagtaattaaagaagatctaactaaaatgagaggcaaagcattttcattgattgttatgcatattcattggtatattttaatgacaatacttcccatttatcaatgaattctaagcaattcctatcaaagtcttggtaagcttttcagcagaaattgacatgattggaaaatttatatacatattcaaagagctggaatagccaaaggagctttcaaaaggaagaacaaaatttgaggcttacactacccaatttcaaaactaagctaaagcaatgaagacattggtataagaagaatcagatagactgatgggtcaacaaactaatgtctgtgggccaaatatgtctgacctctttttttttaataatgaaaatcatattggaacccagttatgcccatttatttacattttatctgctgctttacactgcaatgacagatttgagtagttgtaatagagatcacatggcccacaaaagcctaaaatgttacctatctggcccttttataaaagtttattttcttctgatattgataaatggaatagaattgaatgttcagaaatccttatatttatgtcaactgatttttaagaaatgagtcaagacaaatcaatttggaaaagaatacattttcaacaagcagttctggaacaactgaatttctgtatatatatatgtatatatatatatgtatattcacacacacacacacacacacacacacacacacacacaagacacttgggagtacttagacccttaccttacaccataacacaaattaacgcaaaatagatcaatagatcatagacttacatataaaatctagtaccacagaacttctgaaaactttggttcggcaaggagttcctacatatgtagccaaaatgttcacaaaaagaaatactgataacttgaacttcatcaacattaaaaattaaaatcttttgctcttcaagactaggagaaaatattttcaatatctatttgacaaagagcttgtatacagaatatccaggatatataaagaactcttacaactaaatgacaagaaaatgaacaaaggattttttaaaaagggactaaagatataaagagacaattcatccatgaagatatacaaatggttaatagctatgttactaaatatgctcatattgattagtcattagggaaattatagttatgaaaattgaaaccacaatcagataccattagacactcgttataatggctttaatcaaaagaagaaactactaagcgtttacaaggatgtagaaagactaaaaagattatacattgtttatgggaatgtaaaatgtcagagttgttttggaaaacaatttggcaatttcctaaaagtgaaacatacacttacatgtgacccagtaattccatttctatgtttacagaaaggaaattgaatcatatgcccacacaaagacttgccaattaagatttgaagcatgaaacattattcgtaatgtattccaacactggaaagagtgcagatgttgactaactggcaaatggatgagcaaaatttgtatttccatagaagggattactactcagcaataaaaaggaacagatttactaatacatgctatacagggatgaacctcaaaaccattaggctaaagaagccaggcacaaagcagtatatattttatgattctgtttatatgaaatgtcaagaaaaagcaaagatacataagcaaacttttggagtgattatgatgtttgagaactggagtatcatgatagttgcaaaactatacatttaaaaaaattcactgaattggacacttacaatggatgaatttcatggtgtagaaattataaatcaataaagatgttaaaaataatcttttttaactttttgaaacatagattactgatttcaggcatttttattacataaatttagagctctaaatgatacctaaagaattgtatacttatttttattgaggtaacatttatatatggtcagttctgctataatgttatatatgtgctccccaaattactgtgccatggagaattgcccaacaaaacacagtgcttataggaaaactggattgagtggaacgatatacaatgtcatatatcagtgacataaaaaatgatatgaacctagataaatggtagcaaaattttacatgtattaaatggacacgataaaaataaatgctacaataaatatgatgctttaatttttaaaagacctaacatttgcttgtggaagtgtgcttccgaagggtttagcttacaagttattgtgaagtggtggaaggtgggtctattagttttctggggttgctatgacaaattaataccaactgggtggtttaaaacaacagaaattgattctcttatgctttgggaggttagaagtctgaattcaaggtgttgacagttgctgcttcttctgaagtttcttgggaagaattcttccttgtctcgtctagcttctggtgcttgctggtaatccttggagtttcttggcttgtagacgcatcactctaatgtctgcctctgtcttcacatggccttctcccctatgcctctgtgtctttgggtccaaatctcccttttatgacgacaccagtcacatttattttaaggctcactctaatctagtatgacctcagtttaacttgattgcattggcaaagaccctatttccaaataagttcatatttatcggttctgaatgggcatcaattttgaagggacactattctatccagtatagtgagttatttgaaattggacagaaagttgtaacactagatgagcatgggaatggcttacaacacacataatgaactgaaataattgctagatgtttgaaatgtatgtttgtgcattatttaactcatttaaacttggtgaaatttttggcatgcagctagttttttttcatgggccaaatcctgcacaagcaaacacaaaattccattctgattaatatattagtcaggttggaatgaatttatggtttcaaaacaagtgttataacagaactgattgtcaatagaatgtataatttttaatcacattgttcagattttgacaaatgcataaactgcataatccacaccttcctcaagataaagaaaaatttcaccagcctagaaaattctctatcgcttcatataagttgttcttcactataggtttgttttacctacgctagaacttcatatgaatggattatgtaatatgtacttttataggtcaagcctcctttatacaatatcatgtgttttggtccacccgtgcttgttatattatcactacttccctctctatattcttttaatgaagtaaaatttttataacataaagtttaccattttaaccatttaaaaatatacatcagtgggttagtgcattcacaatgttgtgcaaccatcaccactctctcatcccagaatatttccatctcctcaaaaagaaacctcataccagttaagcagtcatttcccattccctcctaatcacagcctctggaaatcactaagctactttctatctctatgaatttgcttattatggatattttatataatatgaataataaaatatgtgacctttgtatctggtttctttcacttagcataatgttttccagatttgtccacattgtggctgtatcagtacatcattcctttttatgattgaataatattccattgtatcgatataccacattttttatccatttatcagttgatgggcatttggacagtttccactttggggctaccgtgaataatccttctatgaacatttatgtttaattttttttggaacacgtattttcagttcttggtagtggttaagagtaaaatttctaggtcatatggtaattttatatttaactttttgaggaaatgccagactattttccaaagcagttgtactcattttacactcccatcagcaatgtatgagaactccaatttctccacattctcaccaatactctttgaaaagttatagtgtgtgtgaagtgatatctcatttttaaaatttttcatttccctaataactagtgatatttagcatttcattgttcatggctatttgtctaccttctttgaagaaatgagtgctgaaatcatttgtttgcttttaaattggcttctttgtctttgtgttgttgaactgtaagcatgctttgaatagcctaaatactacacccttatcagaaataacatttgcaaatattttctcgtattttgtgaggtttttttcacttggtttttttaatagtgtcttttgagatacaaaaaattttaacttgaatgaagttcaaattatctattttttcttttggtggttgtatatttggtgccgtatctcagtatgtattgcaaaatccaaggctatgaagattgatctatatttatttttactaaaaagttgtatagttttgactcatatttagggcttttatccattttgtgttaatttttgtgaatggcataagataggtgtccagcttaataattttatatgtggatatccagtattcccagaatttgttgaaaaggctatttttccccattgaatagttttggtgccatgtcaaaaatcaattgaccatggattatgatgggtgtattattggactctcaattctattctctaacctatatgacttagtatctcattgtttttgttactgtagctttatgataagttttaaaatcaggaagtgtaagtcctccagttttgttcttttttttaaagattattttgggtatctgagttcctttgcaatttcttaaggatattaggattatatttttcatctttgcaaaaataaaagttggattttgttaaggaatggattgaatctgtacatttttcagtccattaattatccatataactcaaattaatagacatgttcaagacactggtatatatatacatggtatgtacctaatgaagggtgaaaaattcaggcaatcaaatggagttttacatcaaataggaatttttttcttcacttaattacataaattttgcacttttcaacaaagccgtcggtaatttttgatgttttcaacctttttattttagtcattcttattggtatgtaatggctaaatacaatgctttatatttgattgaattacaatttgtgaggcataatatacttaaactaaatttttaagtcattcacttagatttgtcacccctgatgatgaagaaaagtaaatatttaaagagacattggttacctcagaagattgtcccccatctgttaaaggaatcatctggccccttaaattccaagataagatcagttagggagggaactgccaatatttactttcacctatccacttcatttgtttttcccttgacctattgaggatcctggaatatgtccattaattatccatagaacttgaattaataaacattttcaattttctggtatatatatgatgtgtacttaatgaaggatgaagaattcagacaatcaaatggagctttacatcaaatgggaaattttttcttcacttaatttcataaatattgcaattttcaacaaagccattggtaatttttgcaaaaatagcacttcaaaatatatttcagtttgatatctgagtgctaaaaggatataaacaactttcatatacgtaaaacattaaaatcagttttctaaagaaatctttatggaatttctctaaaagaatcattttttccatttataatatgtgatttaggcatttataacactcagggaaaaatgagagcaatcataggaaaaatacctttttagaatgttaccatttcagtttgtctcaaattacttttaaaggtatatttttgtaagagaagaaattcaacatatctgaatttaatataggctatggaatgtatgtcctttcctataacaattttgtagaacaccattattagtacatattgctcaagtgagagtttaaaaaacaaaacaacaacaaacattcctatggaatgcattgatgttgcagaagtatcttctactaaaattaatttaaagttatatcatcgtggctgatttagatttcagtgtagaatattatgccttgtggtaattatcttgtgtcttttagatttgatatcatcttattatgcttctgtaaattaaccacattgtcaccaaatagaattgggccttgattattcaatgtaaaacagaacccacgtagccaagacgtatgattaaggttatttaataactattaaagagacaattttgatgcataaatctggaatgccatctgtcaacctaatgaaaagaaatattatcttgcattttctttttctgttattgatttgtggtgccccaagaccattttaaaaatgattggtgtagtccttatctgtcatggaaacaaattcattccttgggtggctgagcaatatgaggggaaataaatttctcagaaatgtatcccctgcaggttgctatccattattgttataagtttgcaatggaaatggctttattgctacatagagaatatgataaaatttaaagcttgtgaaagatgattagaaaacaagtataataaatatatatcaccaacaatatatcaacatatgtaatacatttatttatttagacaatgttttgagtatatcaaagcaaatgggaacaactcaaatctgaatgttaatccaaagaataataaaagtgaaaaattaatgccttcagggaattcggaattaaaatattctcccatttccaacatagagcatttacattttctacttggatggcaggtatgagctctataaatcagatttcatcatataaatctgtttcactttacctcttccacactgcttctagtctgagctttagtaaggcttcatgaatctttctaaaagataatctcagcagaaaaataaagcaaaagttagtggaactaattctgttacttgagtttaaccttagttctatgttatcttcggccacttttatatgaacacatcacagaagctgggatatgttattttattgtatttaagtaaaatccctcgttttcatatatctatacacaggtaaacatatctatctgttttaaaacagtaatatatatttcaacttatgtggatatatcaacaaggatattaaagggttcatatttttattacagcaaaaaactagaacaaatgtaatgttctgcaaaatatactcatgtcattctctctggatactaagattttgcataattttaataaggttcttcttatatatataattttgaatttgtttttccaagtgactttttgtgattacaattagcaaagctaaataattgccatctattgtacatattacctatttttcattaagctttgctttctattttttttaatatcatgattcctggaggtaggcaggtagaaagcaagatagctttattagagcaaacaaaaattgagaaaaatactgtatagtatgattagaggatttattgtatcaacagctgaagtttcccatagtagcatttgtgtttgtaaatccaaatataaatctatattttagtatcttggtaccacagcagctaacacttgaatttcattttataactacctattctatcaagcttaaatatttcccattaagaatcattgcagtcaataaaaatatggctattataagtctgtcttttaaatatctagtttcaatgactccatgttgaaaggcctatcctttaaaatgatattaatcacattgcatggtaaggtctaaaatttcaagtgctgctttgacatttttgagactcacaagatccgtaaatcttacaagctcccctgctcttgccaaatatgtgtcctgaccctcttaccccacccctcagcaggaaagcacccctacctggctagttcctctattagtcagatgagttgcactccacctggctctcaacctaactgtcattctggggaattattctaacaaaccaatcacattctcctgcaggaaccagaagacagacacctcatcctcctattactataaagcctgtctccaatatccctgttcactctattaccaagtaaaaaccccgtgtagccttgcatggcatgggatgtcctagactgtgagtatctgtgactcataaactgctgtcagtttcactgggccagtgatgggtgtcatccatttggccatcttgtactatttagtccaggggattccctcattaacaatggagtgaataggaggtgatcagaatgcactacgatgaaagtgaataattcattaaattacttttcatatctttgtgagatttaaatgtccatataataaagactttgctttagcttaattttgttgtattaaaccattcaaagacagtaacataattttagctttaccgtaaaaatgctatccgcaaaagtacataaaatggggtttagcaaaaactaatggcttttcttttgaaaatgataacttatccatttatatttgcttatttaactcaggaataaatagctcttagacatgatgcatgcttggtgttcttgtgtcatacattagtcataaatttaacattgcagcaatgatatttgagaattaaattgaattagttttgatagatccatgaatgatcatcactatggacttcatgccacataatttgtaagacctagcatagctgctttgtcttctccaatttaattacagatcctcaaaatttacctgggcatttttatattcatggattttttaaagcaacagtttacttacctgctaatcttttccatcagtagccaattaaatggctaacaggaagtctaaaatgcacagacacattcacatgcatcacatatataattttctacacataattaaatataaactgataataaaggataagggttgattatttgatagtgtcattatagtgtttaattaggattcttggagaaaaggcatagttttaaaaaatagtctacaattaaaagcataactgtataagcaaaatcattggagcagataatgcttagggaagagggagaagtaaaagcattcaaagggtctcactggtgaaagaaatatctatgtttttgctctgaaaagttgatcaggtaagagaagttggaggatagtgactgcattcactttttttgtgatttttctgttctttaacaaaatgtagtttaacaaaaaagatttcactcgtttcaaagaaaattaaactgcagtaagatatttttcttccaagaagtaatacataaacctctcttgcaccctgcctcccatcctcttagcctccctttactacagcaattcttgagacaagctgctgcaagcagatgtgacttgccattacatcaccacagctgcatcaggtatccttgctctctactcagggcttgtctgctgccactgtgtggattgcctgcaaggagctgctcaatctgactcaggcataagcttaaaagtgcaaggggatgaacaccccatgaagccacccatgccaaatacggtgtaggaacagatggatatctaaagtctctcctctttctccttttgggtggataatttcgaggaggacctagctcttcacagggctcttcacaaggttcctagcagggtcaggtcctaattgcccacaaggctgggtggcttggttactcacccttggactttcttctctcctcgtttcactcttcgcctttcttttgatcccttcccttttcttgtgatcacttcctttttcttggaatcactttctcaaatagatcacctttattttcttggcagaacctaggctaagacaagctgacaatggtacaaagtgagttaagatctgctgtttcttcaccatagaagaatatactaatggagatctctttcctgctacaagtggataaacaaaacgtacaacgaaaataaaacatcactcaaaatattctaaattcctgccagggtcaaaagaaaaaaaggaaacccttggtaccaagctacaataggggaaaaagagctaaagaagaaaggccaggcactgaagctccagtgacctagcgcgagagccatccaagtataaatacaaagatgaaaatcatccaactacatttcttagccaatttcataccagattctcacaaataatgactgctttttcattgaaatatttagttgttaactaaattggccagataactgatttttggagccatatagtcgtgcttcaatataatagggatacttgtttctttcccaataatgaatatgaatctatgttctcttctccttgtcattagttataaactgtaagaaatttcagtaaagcataagtagtaaatactatactaccacaaaatccagcagtttattttttatctttgtttaacattcttagcccatcccactgcattttagacttaattttcaacaccgtcaaagatatggtcccttatttaagatgccatctagagtataatagcatttctctgagttgtcaaattttacctttgtaattaatgagaaattatttatttaggttaattatcctgatttatcaagcagacactttaaaatcatagtgatagttctctgtattttaatgaatgaagaacatatgaagagaagtgttttataatatattgaatttaatttttcatagaagaaaatagggtttctgccattgctggcagtttataattacttttaaatctcaattgccttaggaaaatagtcatttgattataaaatcactgtatgcaccttctcttgccattgcattaccaagcctttcacagtgattataaaaaagcatattttaattgtattgtatttgatgtatttatactatattaaaatctctttgaattatagaagattttaatatttgagtgctaataagagtcaatgtatagaactgaaaaatttaaatgccctttgcatgtggacaatacacattttattaatgtcatttcagtagatattatctctggagcttttatcttgataattatttgggatattttaatttggtgagttataatgtcaatgaaaccaaagtttaaaagttaatttcataagggaaatttttcttagcagaaaggccaactgccacgtggagaaacacatcatctttaacttgtacacatgccccaagccttggtactgtgaaaaaccatggctgttgtcatagaccttcacccttagaaattataatgccattgtatcccttactgtattaattcactagtaatttatatcagattgtctttcaaatggataatttttcctccaaaatagtttatttttgtatgaaatatgtattagtccattctcatgctgctatgaagaactgcctgagactgggtaatttataaaggaaagaggtataattgactcacagttccgcatggctgctgaggctgcaggaaacttacaatcgtggtggatggggaagcaaacacgtccttcttcacatgatggcagaaaggagatgtgccaagcaaaagagggaaaagccccttataaaaccatcagatctcatgagaactcactcactatcatgagaacagcatgagggtaactgtccccctgattcaattacctcccatcgggtcccttccatgacacatggggattgtgggaactacaatttaaggtgagatttgggtggggacacacagccaaaccatatcaaaatcttttgccagctataaagtaacttatgatttgcaagtgattgtggcactgagaatataacacttaggagcctatatgtttgttgagtgaatgtaaatatattggaggaaccagcccccaatatttcaacataggttcttttctattttccctaagtgtcggccggtctgagaaataaagagaaagagcacaaagagagaaattttacagctgggctgccagggtagacatcacatattggtaggttccgtgatgcccacctgagccacaaaaccagcaagtttttattagggattttgaaaggggaggagggtacaaatagggagtgggtcacagagatcacatgcttcctagggcaataaaagatcacaaggcaaatcgcggaacaagatcacaagcccagggcaaaattagaattactgatgaggttccatgtcccactgggcacgcattgtcattgataaacatcttaacaggaaaccaggttccagagcagacaaccagttgccaggctggaatttcctaatcctagcaagcctgagggcattgcaggagaccagggcatatttcatcccttatcttcaactgcataagacggttgaagacactcccagagtggccattttagagacctctcccctgggaatgcattcccttcccagggttattccttgctgggaaaagaattcagcaatatttctcctattcgctttctgcaagaagggaaatatgactctgttctgcctggccccacaggcagtcagaccttatggttatctcccttgttccctgaaaatcgctgttatcctgttctttttcaaggtgcccagatttcatattgttcaaacacacgttttaaaatttgtacagataatgcaatcatcacagggtcctgaggcgacatatatcatcagcttacaaagatgatgggattaagaaattaaagtaaagacaggcataggaaattataagagtattgattggggaagtgataaatgtccatgaaatcttcacaatttacgttcagagattgcagtaaagacaggtgtaaaaaattataaaagtattaatttggggaactaataaatgtctgtgaaatcttcacaacttatattcttctgcagtggcttcagccagtccctcctttcggggtctctgacttcccgcaacataaatataataatgtttgtatatcaggtgcagataaatagccattaaggttggtattttagcatctaagtattttttcactcagttgggtcttagaacagaaaacatgctattttctaattattggtatatacatccttattgctacattgatccaacatattcttaggaatttacagtttttgtatatttacctttgtatatgtacttctattttttaaattcctaccattagaaattaatatatttgaaagttctgggaatgaatacattttaacattattgaaggaattatgtgatatattccaactgtcataactagaggagagtatgattactctagaatgttacacatggtagctgtgtgtgtgagtgtctgtgtgtttagggagaaaaaaattatttggggggagatgtgatcacaggatagcagagatgttaaaaaggaggtatgagtttatgttagaaaaattctaggatgcctctggactaaactggacttaagttattttatgactactaacaattactctccaaggaaagataagatataaatataaaaccagtgaatagtcgtattaggaggaaagcacttaaaaaaaagacacaaagtctatttagccagaggtcaaacaaacattaatagaatgaaataaatgagtttgctgagttcaaagacaaaaataaaccacacattagctttaactaaatatctacttttaaagagaatatatatatatatatatatatatatatatatatatatatatatatatatgtgtatattccaatttatgttataaatccttttttgtcttcaaatgatgtttttctggggaatatctctaaattgacttcttaaatgccatgcatatatactttaattcccctagtaagtcttcaatgacatagaattggataatatggccatcttgattaaacttccacattttactaaaaaaagaacctgagagcatagttggaggttggactggtcatggctataatgggaggctgggaaaagggtagagaaaaatgaccttctttcctgctgggcaagtggtctctgaagcttcagaggtttctatttggctgtcttatagatcctgcccacagtcataaagaaaatgaccagaagcaagaacttggaggtaaaattttgtcttctactcttaaaattattagggacctagtcattacctaacaaaaaacttctaaataatcgattcaaggaaagtaaaagaaaatattttaaaagaatgatctgagatggacgagggcatggtacacaaaatttggtaaacattggtaaatctaaacatacaagcatgaattatgatagcaatattcaaatcgtggtgttacagaaatacaaaaagaactaaaattctggaatgtttgggggaaaatagcatagataatgagagagaactggttttttaaaatgtccttttattgttcagtagaagggtagagatgttgactaactttggacttcatctatacatgttaaacattataacagaatgcaaaatgtttatcattataaagacaactgtagaaggataagaaagtaaaacaaataaaaagcaataaaatgataaaatccaaatatggtagaagacaactagtaggactatcatttccactgaggatattaaggtattatcagactaagacaataaacaaatcaataacaatggaaatatatgttctatttataagagatttatataaaactcaagtacagaaaagctagacgagccttaaatattttcctgactgattgagatctggcattctgatttaaaaacacgttagtcaatgattaactcagtgaagtagggattgtggcctttaaattccatttcccactacagcaagtcaggtttcttggagaaatgtctgattccaggtctaggaaaaaatagggtaaaagatcctggggtttcttattgtaacagaaagtgagataggtatttaagactactaaagttgtataaagaactctaaaaccaaattgtaaggtccttctatttcatgagcaccaaaaagaataagaataatgcgatgcaacatattgtatatgttaaaaatcagttaaaaagaattcgtttttcattgtccaaatgtggatcatctatggaaacactttataattctaaaacccagtgaattaaatgaaaaagcaagcatttatcttccatttattgtaaaatctgcacctcaagttaaccaaatagtagatgaataagtgtttgcctctatagaaaaacacgcagctgataaatgtacaaggaacaattgagttggaattctaccactttgcaatagagatttttggatctctgtaattactgaatctttgtaatatcaatgtcggctgacactagtgagtgaaaagcagatgggaaactttttatttatttatttatttttgagatggagtcttgctctgtcacccaagctggagtgcaatggcacgatctctgctcactgcaacctctgcctcagcctctcaagtagctgggactacaggggaatgccaccacgcctggctaatttttgtatttttttagtagagacagtgtttcgccatgttggccagctggtctcaaaatcctgacctcaggtgatccacccgtcttggcctcccaaagtgctgggattacaggtgtgagccaccgcccctgccaggaaattttttaatgaatgagtggaggtggcaacacctgaacctattgaccaatctcaaaaagaaaagcagtcacttgttaggtgccttcagatatggtgcaaaaaaaaaaaaaaaaaaaaaaaaaagaaataaaagctatattcatttttgacaaaatcctaatctattagtctgtcattttgtgggaagtacaagagacaaagaaacaggaatgcaattagcaaaatctaatctttagaaaatgttttaagaaaaatagtccaggttcttcaataaataaattgaataatgaaagtgagagaagaaagctacaaaagaaaaaatatgtagacatattaagtaaaagaaatggaaccaaagtgtagacatttgaatttaaactaaatatttgatggtatatagcaattactattatttaggattataatgctattgtggttatgttttttaaaagagtatctcttaaagatacatcataaagtagagaataagttttaataggttttgtgtttgtttcaaaataagtacaaagtggaaggaatagataaagcaatattggtcatttgttgaagctgtttaatggaaatatgaatgccctttatactattctaatttggcagatgtttaaaaataataaaaagttgaaaagtgttggtcatattaatattcatttaaaatgtgatttcattaggaagaaaaccctttggctgtatttctaatttcaaggatatctctatatatagctacaaatagaatacaatgataagaaaaggaataatggaaaagcatgtgatcctcatttaatctgagcatttcattggagagagttattttatgtttataacattgatgataattcattgtgaaaaaattgtgaagtaccttgtaaaatattaacctcaactttagtaatatgcaacttatttttttcaaaaaataagcaccgtcattatcaaacaccctaagttctagtcaactgatgaatggcctaataatacatttgcccttgaaggacttatgcactgtaatatttttaatgcataagggagtatagatacacatctgcataatcattataactttgtcatttcagtagtctgtttctattttcaattctataaaaagatagattttgagttttttgcataccatatagtagtaaatccaaaagagaaacaatagtagtcaataggtagagacattaagtatatgttaaatgaaaaagttatttaataaatggttgcacatttataggtaaagactcatgatatttcaacaacattacaatcttaaagttccttttattgactataacttggtgaagatttaattaatgcatattacatctattaacacatctccaatgtgtgtacattaataaaaacaaaaatttcaacttggttgtttgaaattcatcttttggatccaatggataaattctttcaatatttatcccattagaattttcaatatttatcacctgttagaatattatcacctgttagaatcacctttagtaaagacttagcagtttttctttaggaaacaatagtacacaagtgaattttcttagtacacatgaaacattggaagtaggctatacaagttaatgagagaaaagtttagcttttttctgacttagaaatcaggggagcacaaggacagaaataaaagtgtctgaagttaaataaaaccttcaaacaaacaactgttctcagtagagtgccagagggaatttgtatagctaaaaaagactaaagtatagcaaatattaaatttaaaagtagcaaaaactgaaaaatatttagcatatctggttcagacacagtattttatctattatggtaacagtgctctctttaatcttaagtctcccttaagaacatttaactgtgaactagaagagtaatgctcaaggtctgtttctaataattagtagtattatgaccctgggcaattcactcactctttagattcagtttttatcctcttttaacttcagttttattttttattattatgacaaagtaatcataaaaatacttcttattctttccttaggattattgtgagatcaaataattagttggatgaaagtgtattgtaaatttatgtcaatgttaataccagttcagacttacaccctgcatttctaatgagtgaggatcagtttgggcatatgggacaaagaagcagtggaagacactatgggccagtcttatctagggaagtgggggaatgatgctaccacattcaagactatacattcagtgaagaaatgtttcccttttcaatacagaacatgtgttgaacctcaaactgtgcggctcttaaaggactttaagggaaaagaatccttcataaagaaagtcttactcttgaatgttcttctgcttcaaggcattggggccagagtgcttcttccacacaagtcaattagagcttcgattttcctgtttgcctttgggctccatcatttcttagttgtatggacttgaaaaggttaattcactctctaagcttcattactcctctagtaacgctgactgtcacagttaagttcagagagtagaacttaataggacttgatcattaagcaattttattttcctcccacttcctttcaaacgaccttggtgcattagttgttagttacttctaatatggactctcacagaagtcccatgacttttccagttgctcttagatttaaaaaaaagtcctcagtatgtttctagttagaagcatgctcactctcatttcattacaatgtgagtgcaattgaacaatcaaaattccaactttcatttgaggttccaacattcccctcccacaccttgagtgttctgcagggttgaaacagaagtgggagaggtcagtgtgatctacttccctattccccctttttctgctaatcctcctctccttccgatcccccaatctcccatctttccacctgtattagtctgttctcatactgctaatgaagacatacttgagactgggtaatttataaaggaaagaggtttaatggactcacagtttcacatggctggggaggcctcacaatcatagtgggaggcaaacaagaagcaaaggcttatcttttttttttttttttttttttttttttttttttttttgtgagacggagtctcgctctttcgcccaggctggagcgcagtggcgctatctcggctcactgcaagctccacctcccgggttcccgccattctcctgcctcagcctccggaatagctgggactatagggaacagccaccgcaagcaaaggcatatcttacgtggtgacaggcaagagagcttctgcaggggaactccgatttataaaaccatcagatctcataagactcattcactaccatgagaacagtataggggaaaccgcccccatgattcagttatctccacctggccctgcccttgacatgtggggattattgcaattccaggtgagatttgggtagggacacagccaaaccatatcactacccattagttcacccctggcttctccagtattaggatgggtaaggtgagaggagagatatgaggaaacgaaccattgtgaaatgatatttatcttttctaggcttggcaggtggttgaaagttgactttcaccttggatatttttggtttcgcagagttcacccccaaagctccgtaaatgtccaggtagactccctgtgatgcagccaatgcatcttttctgaggtggctggtcacttcagattcctcctgaattcaggcccctgttaccaccttctactagacctttcttcccctactccatggcttttttttggccaaagtacttttcacagttttacatatttccttattttctttccttttctgtgaatataagattttagaaggcaaagattacccatgttattcattactacatctcctatacctggaattatgcctggcatgtagaaaatgttcaataaatatttgttgaatgaatgagtgaataaatgagcatttggaagaagatcctctgtattggggatccatcgcctcttacacagccctgtttggtataatccagactaagttcttgctagctcccatcaaaatatacataactagttccccccaaacactaacatttgacaagtggaagtgcagctacttcccagtttaactctctgtactgttgcagcaactagataaccataaccacaaactcatatatttggaccttcatagataacagtctggcatctgtctcaatgtctcataaggtacaaagtcaagttccctgagtcttaacataccctcttgatggcttaaaatgtggaataaatatttatcactcgtctcatatgaataccaccacgatccaaagaaattcaagtactttccctctccctctctaaccacttaaatattattgatgtggatgttgaggtgagatgtgcaaagcagaacaacaggcaccttctttgccgtttctgcataggtgtggtcaaacaacttgtggtcaaaaattgctttgctctttgacatcagagcctcagtcaaatttgagacaagaggagttctactttgaaatcctgttacatctactctgaaaagtaagtaagtgtgtaatgaggtaaaattaatctatagtttaacaaaatgcttaatataaaagaaatatttctttctcgagtctcttccttaaactcattgcttgctgttcctactacaataaaagatagaatcttagcccataaatgcatgtccttagaaatttgtaagtatagaaaaatagcaaaatgactaataaattcctttgaatatccaaataagaaaaaaatgtataaacaagaaaaatcccaagatcatcataaatacttcacatgtaaattagagttatagtatttatttttccctgacaagaatttattatctcctgttactaatttttaaatttccctttagatgtgcaagctaggcaattttaacttgtcagagtcacataaattactgactcactttaacagcaaaagctattttctggtttctagtgattagacctaaaatacattttatagcaaagtatgagattaaatagtttcacctctaaatgtggtatgcatgtgcttcttgtatcctccttaaaaattaactattcatgtttagtagagaggaaattcaccagggacaaagcaccgcagatgagctcattctcctgttaccttgatgtatggaattattcccccaggtccaaatctaatcaaatgtgaccacaattcatctaatactttcttccagatctgtgcagcctttgcagtattaccaaataatgaattcttctacagagacacctataggaaaatccttcaataatcaagtaattcttgagagaaatatattttattgtgaggttacgagtagctttatttgaattttcagtattctaggaacttggcagattacctgagtgtaataggatggaatgaaagatgaagttaaaaaaaaaattcccaaatgttaggaacatttacaagttgaaataaataacatgcattagaaaatataaaatagcacaattgtttgtgtataccatttggcaaagctcttcattgtttcaaaatatacttaccaataagaattgtcaatatctatggatcttatatctcaaatgcctttataacaaaggcactctggaggtatcccaattctatgtattttgagaacttgtttgaagacttagggcaaacgtcttaagagggatgccaagtaaatagctgtcttccattttcacctgtatcaaaaacaatgtactcaaaggaactttttatgagtgtcaacaattcttccatatcgtgttccaatagtccacaccatgtttcataatgcacattccttgaaacccctttgggatctttgtgacagtttagttaagtcaaaattcaaacatctatctccagtcagccatgttctggagcccatgatccaaataagactcatgcccagccttcccaccagctgggcttttgtaggaacactgctttaatgtaatagtggccatagtgcagtgatgagccgtagacctaacaatatgttatagtaattgaaaatcaccatctttggggccagagcaacccaagttcaagttctagctcatgaatttacaagctgggtgaccctgggaaattgttataatctatataataagcctcagttgcctgtctgatgggaaaaggaaatcagatatttaaagtgtttactatgcttccttgtacatactacaaaataaatgttagtcatcaatatgtctgttactattaaaataatcataatatggtaataaatcatggcccagacaatcacaggttttgagggtggaccagcatgaaatagcagtgtcctggcagacagaaggagagagccaagtagcagagaaattaaaagcagacaatatttagcaattcagtgaggcaggaggcattaggaatatttggcagtagtaagcaagtttttggccaaagacctgggtttcagattcagggctgtctgtgctttgtttcacaggaaagggtaagtagatttaataaaagatgatgagagatgcttcctagaaaaattggaagacagtaatttagacacagggaacaaatctggtaaccaaaaacaggagaaaagcactaatgtagcaaccctaccaaaccaacacctagtttctaaagtttggtagggttgacatgatggtgagttttttgatgtcctgagatacctgaaactggtcagggaaagtccctgagttttagatacggatatgcctgtatgtgtctgttctgtgcgggaaacacacaaggcaagaagaaaaggcacacatacaatacctttaagggtaaacaagatttatcccaagtaaatggcaatgggatatattaagcaaatgatataataagcaaagtaatataataagcaaatgataagcaaattgcaatgggaagggggaaaggaaaaggtatatgtatatatttacacacacacacacacacacacacacgtactctcaccagactatggaggattcaccaccagactgggaagcaacagcctgggctccagagtcagccacctgtccatgcacagatgaggagaggtctcatgaagattcggcgcagtctgggaccctaactttttttgtaataagttgcttggcatgaggcccagtcgcgagggccctttgtgacttggcttaatgaacacaaaaacgttaacttgttttttcgattgtctattgcttttcaataactaatgtatcggaatagattgaaatagagatttctccaaaatagcactggatgaacgcctcaaggggcccacataacctgctccgggacgtggtgatcattgtttgtgtccatgttcaattgagttcaaatttaatatttaatgtttcctccacagtgtcacagggggaaggatgagggagaacactaagcattattttgaggaaagcatgactatggggataggttctgacagtaatcttgctatattgctgtacagctcccaagttttagaatagtgataaagagatgttcaataatttttaaattaaatctgtatatcacacatttgctgcccccacctacacaggctgatcatgggggcataatgttaattcagttttgacaccaatttcccaaaggaatccattcatttctttaattagtttttagaaaagaccaaagtatacagtcatggtggaaagaagaaggtattgcatggctcacctagcaatttcctaggtttctttctgttcttccttcttcccaagtatttttatgtttatatttttttcatttttatagtgataaaatacacaacataaaatttgccacgagtggcatttagtacattcacagtgctgtgcaatcattaccactatctaattctggaatattttcatcgcggcaaaaagaaacccaataccaactacaatctgttttatgtctctatgaaattgcctactcatgatttcataatggcatcatacaatatgtaaccttttatatcatgcttctttcactttgcttattattttcaaagtccatctatgctgtagcatgtatcaggactttgtttattgctgaaccatattccattgtatatatgtatcacattttatttatgcattcggcaatagataaattttttttttcatcttttggcaattatgaatagtgctgctatgaatatttgtgaacaagtttcgtttgcactcctgatttcaaatcttttggatatatactcaggagctgaatttctagatcatatggtaattctatatttaacttatcaaggacaattgcacagttttatattcacatcagcaatgtacaagggctccaatttctccacattcttgataacacactattattttccactttttgtttgtttgtttttaattaaagtcatcctagtagatatcatctatgatgtgagatttcaatttacttttgatttgcatttcccaaatggtgaataatgttaagtttgttggccatttctgtattttactaagagaaacatttattcaagtccttggcccatttttaaattgagttgtctttttgttgttgagctgtaagttttctttatatattctagatactagacccttatgagatacatggtttgcaaatactttcccccattctgtggactgtctttttgctttcttgataatgttctttattcctgtctttgatgttttacctccaatgtcttctttctctactacctctcaggaacaaatatgttccttcctcggatgtgaatgagaagttcctccacactctttataaccaaaacaacagtccaaatacagtcaggcactgtggagcttaggcttcattagggatattctattatctcaaaaaagataggtctgcacaaagagaaattttataccagcagctaagaaaataaagtatattacatatttttttcagtaatggaagtttcctatacagagcaagaattcttttctttcaaaacattatacaaaatgatactgctattataatatagttattcctagcaaagaagtggattcaatggtgatttgggttttaaacaattgataacttgtcctgggagcattaaaaaccctgatatagacacatgaaatataattcttgcagattcaacactatgggtaaatcctatctgcagaagaacagccgtattacagagtagttgtctagaagtcttcaactacatggtagaattagatcaagtgtgaaatattagatacccagacaattgaaaacaagatgggcttaaaaatttatactagcttgtgtattcatcctcaaccataaataaataaaacaaaaatgtagactttataattctagatggaaacatggagtctttttttactatcatttcctctagtttcaaaatatgtttaagtccatctttattcttgtgctatataaagaacatgctttttgacatgtctttactttagcattgtctgcttttctgaactggtttgatagcagtacctaaagaataaatatctgatatcattcacagacaggggcagagcagataatgtaaatataaacttattacttccttaaggatcagctgtttttggttggtttcatatctgtattctgtcattctgtattctgtcattctgtattctgtatatctgtatttcatgtctgtatctgtattcccccaacaattctgggtgaatatttgtttatttctatgaaatttatttgtttgaatgcaatgttttcatcagctgtgaaagtatgatttgaacatgtaatattacatataagctgaattttagcatcattaatgaaacaaatttggttccacagtttttaatcttccaaaattttaatcagatctatgtagctacatacttttctgcaataatacgtatgtattcatatgtacatatgtatacacatgtacacatacacttacatgtacatatagtgtactctagtagattgaatgatagctcccaaaagtatatgttcaaattgtaactcttggtaactctgaatgtaaccttttttgaaaaaaaggtctttgcagatgcaattaacttaatggtcttaagataagatcatcttggattacctgggtgaacccaaaacccaatcactggtgtctttacaaaagtgaatcataggtgtatcatacagatactcctcaacttatgatggggttacatccccatcaaacctcattgtaagttgaaaaatcataagtcaaaaattgcatttaatacacctaatgtatgagacatcatggcttggtctagccaaccttaaatgtgctgataacacttaccttagactacacttggacaaaatcgtctaacacaaacctatcttataaaaaagttataaaaaatttgaatcaaaatttaatattcaaagtatggtttctactgaacatgtatcactttcacatgatcataaagtaaaataatgagttgagctatcataagttggggacaatcttacagacaaaaaaaaaaaaagaagaagatgatgtaaaggcagaggtaaagattgtaataatgcccttattagctaaggcgtgccaaagattgctgacagccaacagaagccagaagagccagagccatatgtatgtgtgtgtgtatacatgtatatatgtcagaatatagattctgtaataatgttttatatatacataaaatgttttatatatataattttccctatctatgtaaatttctgttgttcaagtccactaagtttatgttattaatagctttcttacagcattcttaggaaactaataaaaattttcatactgggaagtggctctggaattagataatggttaggggcttggagaattttgtggcacattaaaaaagcctagatttttcttgaagatattcttggtagaaacatagacattaaaggtgtttctggtgagatctcataaggacatgaagagcataatattgaacactggagaaaaatgtctcctgttataagtaagaagacaacttggttgaattgttttctgctgggtggtaaacagaacttgtaagcagtggagtgggtatttaattgaacaaatttgcaaagaaggtgttgtcaacctaaaataacaacagaatgaggggctcttataaaatgaatttactcaggaatggataagagattaaatctgggaagatacttgccatgaagaaccataaagggccataggtgtacccacagaggcaaagcaaggcaagggtttttaaagacagaataagaagagttattttgaaatatttgttcttggctaccgggatcaaaggctgaacaggcatcagtttgaaggctggacaggcagttgctgggcagatgtcctcgcagaagtattcttcgtgtaaggctgtggtgaccattgggaaagactgtgtttttcagagaatccttgtactattttatcacaggcatatgtgcatgagagcctttcctgtatggcctcccagctctatttttgttagggatttgcgtaagtgactccattttgattctgacaacttttttagtgttaattatgtgccttggtttctccttattgcatatagcaaaatgtgagaagaaagagataaactcaggaaagaactgttaatcaaagtagaattggcactgaattctttggatgggtttctaacttgtgcagattttaaagtatgctaaactaggctgtttactgttaggaaagcattctctggagaaaggttcaagtatgtgtcaggacaacttttgctgaaggaattgggtgtatgactcctggatccaatcaaccctctcaacaaaagccagtaatagggctggaattttctaggaagaatgtgtggagaacgctcttgtctaatagtatgtacacccatggcttacatgggagacagacaagatgtttgagactgctgttttagcagaaacactgccagcttggacaaaagaggacagagacagaataaaatgaagaatgggtgttgggcttttgagattctataggaagtgagcttatagggatcattgatttgaaaatatatgctacctttctagaaacaaaatgactccaagggcaaagccaaggatgcagacacagaggccggaggggtgggtacagaggggtatggagcctgctgctgccagaacttctgtgagataatacattttttgttattttacattaccaagtttgtagtaatttgttatggcagcctcaggaaacaaatgcattcatatttcctgaaattttcattctaattggcattctattttagataacactttaaaccatcttcccaacagaatgtgtgactggcaatttctttctctctctctcaacttctctccctctccttccgtccctctccctttcttgtgtacatgtaaaagctagataaaaagcagagtagaagataatatggtatcatgaaaataatttttgaattaaagtcaaactagttttaaagtctactccctcacttactgtgtaaacttgagcaactgagttaacccctctgaacctactttttttgttgttgttgttttttgtttttcttcttttgagacagagtctcactctgttgccaggctggagtgcagtggcgcgatcttggctcactgcaacctctgcctcccgggttcaagtgattctcctgcctcagcctcctgagtagctgggactacagtcgcacaccaccgtgctcagctaatttttgtatttttagtagatatggggtttcaccatgttggccaagataatctcgatctcttgacctcgtgatccaccccatagaaataataataatgaagttgagaagagatttaaggtaagaaaatatattatatttaaattggcaggcacaatgcataattcctcctctttcctttatgccagtaggaacattatgttatgaaaatcattacaacttttgaataaataaagcagttttaattgatatgacaattaagagagattgatcagaaaagtggatcttttgcagtcattgcaaagcctgcagtgatatagatgcaaatacttatggcccccgggactttattgaaggactatttttgagaatggcttcttgttaaacttccaagtagaaaaaatgctgcacattcagaggaaaataaattattgaatcaatgggaaagagaaaaattaattttattaattctgtctgcattatctgatcctgattatttaattaaaacatactgaaaacctcctggattcccaaatgactttaatgattaataaatatctttatttatgctctttgctcatatttggtttcatttctgaagacacttacagtgggtacgtgccaaggttttcatctctctggcggtagagccctgttagcttcacatggggcatggtaaggataccttaaaaagatgtatctatttttattgattgcttctgcaacttacatttgctccctttatgcatgtaccaaaattctgaagttgaaaaactgattatttaaaattatcgtcatcctaaaacctcaaataattttgaaataattttgtagtaaaatttcctgaagggtaaagaagagtcatctaccactttatgcaatttcttttaactatttctattcccaatttaaaactagttttaaaatattgactctacattgttttctcttccccagatatctcaaccctagttgtacattagagtcagaatgcctggagttgggacatagtattataaataaaagtaaagaaaattgtgtgatgtatttccacataaccaacttcaacaacaaatttatggccaatcttgtttcatctgttccttgtttcatctgtccacccaattatggattatgctgaaccatatctaagtcatcaaataatttcttgtgggaatagtttacacagatatttcatatagaaactatttgaaacaaaaccataacatttttatcatatgtaaagtaacaataattccttagtatcatcaaatatgagtactcatattcccctgaatatcttgtaacaattttgtataatttcttttaatttgaattcaaataatatttatactttgcaattgacagatacaatttgtcatttctatagaatccccttctatatctctttatttgtttgctatttaggtgttgaagaaatgtttgatatggtccaatatagttgctcctagccacagttagctattaaatttcaatcagttaatagtaaaaagaatacaagattgaattacatacaatgtacaatgttagagcaggcacacttgcatatttcaagtgtttcatagccccatgtggctactggctactgtattaaagaatgcagaaaaagaccaattccattactgcacaaatttcttagagtgcactgctgtcatttcccaatgtaagttttattttccgattctacccctatatgtcagttaatctgatataatccctctacttcctgtaaattgatagtcatatttagatcttgattagatttatattcaatattttgcccaaactatgacataatccacctacatcaggaggtacatggtatctggttgtttcttttttgtgatgtcagtagtcactgatgattgttgtctggttttaataaaaatgatatattttgattttctctgtaattgtcatactttcttctttgttcctatacgattgttgttgttgttgttgttgttgttgttttttgagacggagttttgctcttgttgcccaggctggagtgcaatggcgtaattacggcccaccgcaatctctgcctcctgtattcaagcaattctcctgtctcagcctcccaagtagctgggattacaggcacccaccaccatgtctggctaatttttatatttttagtagagacggggtttcatcatattggtcaggctggtctcgaactcctgacctcaggtgatgcgtccgcctcagtctcccactgtgctgggattacaggcatgagcccccacccctggccaccattcttacctgtcgaatcatggtagatttattggaagtggtgctgattatcaatagacttgtatctttgcctctagtatttcagatccctgttttcctctgggagaataaaaaaagcagctaatgatctcacattgtttgtagattttagcttacattttgtattaatttgttcaagagacagagatcctatctttctgggtagtcaattactttatttttattcatttatatataataattttaaaatcctttatacaggataaagatgacaatataaacaactattgatccatccaaacttcactaaaactatcataaagtaattttttttcagagacatagtcccacaaagataggcgagaaaaaccactgcaacagcattttgggtgttagaaagcagatgggcaaggactacccacttagcaaacactaacctagaaatagaaaaaaactgtgaaagaaccaaaattgaactgtaaaattttcaaaaacctcaggaactagcagttatggaactaggagtgaagtaacttgctgttaaagaagatttgagaatgttaaaaaagattcctggataatctcttgcatatcatttaaccacccttcaattactctgtcagtgctctggagatttgggtgtagctgaaggttaaactgtgcctggactggactgttgagaggaaacaaacagtatcataaggagaatgaacagatcccttacatgtaaatactgatatttttgtcttttgcttccacttgactgctagaacatgggaaactagacgtctgttctatagcaggagactagaagatctgtctctggaaaattcgccttcccataagagaaagaaacaaggatactgacatcctggttttcctgaaaactggccgtatctctctgcagtggagttcaagtttgcttagtccccacttggatgctcagagcttttatctgcttttgagctctccacccaatcttaattataagcaagtaaatagattaccaaatatcttgggggaaatcttttttttattttttatttttttgagatggagtctcgctctgtcacccaggctggagtgcagtggtgcgatctcggctcactgcaagctccgcctcccaggttcacgccattctcctgcctcagcctcccaagtagctgggaccacaggcgcccgccaccacgccagactaattttttgtattttttttagtagagacggggtttcatcgtggtctcaatctcctgacctcatgatccgcttgggggaaatctttaatgagaaagatagaaaccaaaataaaccaataggaaaaaataacagcatcttcgaggaaacaaatatgaagaaaaaaaatgaacttgatattaatatcctaagagtggtaatagaggctattgcatttataaaactaaaacaaaaatgacacaaaggaaattatcagaaaacataataaaaactaaaaacatatgcacagtgggaaaaagagccctgtgaagatgttatgatatgaagtctgggaactctctcagagattaaagcaaaaagacaaaaagactgagtagaaagtgttacaaaattagacaactacttgaaatcttgggatttgtcaacaaccacgctggaagcaagaaacaatgtgtgatgacttcaaatatctgaaagaaaattgtttccacctaacaattctatgtttggcacagataccaatgaattatatttcagacttacaagaaagagaaaatttaatttcttattcacctttctttggaaggtactggaggatgtgttctacaaaaatgagcaacttaaccagtaaaggtgaatagaaagatgggatgggaacaggaaacagatgttcaaacacaggaaaatgagaaagactctctataatgatggtgaaaaggaaatccaaggttgattgctgtggtctaggcatagatgataacccatgaagatggctgcaatctggaaaattgataactgagtacaaggtagaacttcatattcacagcaatccaacccacagagtgaactgataggcacaatggatgtcaatggagctatagctttcacttttactgattgaatccatattgatgtatgactgagactggatgagaagacaattaagaagtatgttattatcacaaatgaaaccttgcatctctttcagataactttgtgataagaccttctgctccccaatgtatcacaatgcagaataaaatacaaacttagtcaaatatgaattcttctgaaaagaaaaacctgttgatacatgtgtaaaattctgtccccccaaccctaaattcatattcactgggaatctcagaatgtggtcatatttgaaaatagggtctttgcaactgtagttagttaataagaagccatactagattagtgtgagctctaaattcagtgactggtgtccttatgcaaagaggaatggacaccaagaaacacagggaggaaggaggtaagaaggcaggcagatcagagagatgcaagtgcaagccaagaaatgccaaaaaccaccagcaagcaccagaagctaggaagaggcaagggacggtacttccctagcgcccacagagggagcatggccctgctgacaccttgattcacaattcctgcctccagaaatgtgacagaataaatatgtgttgtattaagtcagccagtttttggtaatttacatgcaattaatatgtttaatatttagaggttcagaatttcaagttgataaaatataaccgtttctataaaaattgggcattgggccattttttaaaaggaaaatcaaatcaacttatttcagcttcaagttgtagtcccaaactatctagtccatcactacgttgtgttaggactgtttgcaggaagttgtgatctgtcctttcgagcagacagccacgctgactatgaagggatgtgttctcagtgagaatggcttggggaaggtcaattctcattattcctcctgctctactgtcttagcccttcccagttgcctactatgtcacccgactgcctccttcatattctttgtaattgtccatatgaagcaactgagaaggttgctttccttctaataccttcctgagagttcacatcactatttccatgtgtcctggagagatgtcacattaaacatagactctattctatgctcttaaaatagttctatcttttacaaaagaaaataagctataaactgaattctgaatggtcagaatattcacagagaatggaatactcatattattttagaatgagaggatgtgtgttagtctgttttcacactgctgataaagacatacccaagactgggcaatttacaaaagaaaaaggtttattgattggacttacagttccacacagctggggggccctcacaatcatggtggaaggcaaggagaagcaagccacatcttacgtggtggcagcaggcaaagagagatcttgtgcagggaaattcctatttttaaaaccatcagatcttataagacccattcactatcatgagaacaggatggtaaagacctgcccctatgattcaatcatctcccaccaggtccctcgcataacacatgggaattatgggaactacaggaggatatatatggattgaatcataatgatattgaaatcctttttgcttttcaagaatatttattaagaagtaaaaattttagccacatcaaacataatgcaaataattattcccagatttcaaccaatttgctaaatggcacactggcaggaattaaggaattcatcctgattcttctgttggttcttttcacttttggggtttcctttctggaataagagtacaatcttttttttttcctgccttgaggaactttaggagatttcagaagataaatgctctttaaattcaacgtggcacaaaaggttactgggaagaaaaaacacgtttgccaatttggacttccaccaaatgttataattggtatcagaagatgtgcaagaatggactcattttgtagtagaatttagatgtgactcattttagtcatggaaccaattttataatgtataagctagatataggtaaaaataaaagagcaaaaggaaatattcttctgtagcattgcagaacccatacatggacattcccttgactcttttcctgtggttacagcagacatctttgccatgcagatagagttgtttccttttgcagacaaatgggtttcctgatatcactttgccaggaagtcaattttcctcaccagccataggttttgtttcaatttttgtttcttgtttttctgagcaagatgaccacacctgttatttagagaggagataaagaaagatgccatcagtgaagtcagtggatcaattgggcatgcagtagaccattgtaacctgttaattctccttaggagcagatggctctaacagatgctatcttaaagtgaagtgggcaaaatgaagtgaggaatataaatgaacagaggcacataatggcacagtagagaaattacagtatatagagcatactgaaaagtaatgaccagaagcataggaattgaatcaaaagaggtaagtgttacagaaacagagaaaaaaagaatttcaagaagagtgattagcagttatttattccagagacattgtataatagggcctaaagttttcctgtgggatctggtaatatgggctatttttgacacagtataaaataataactagtgttgttattgagaggactagtgttgttatgagacagcatgggtagtttgcattgagctaaggagtgaatgagccatgagaaagtgcagagtgagtgccaatttctcatttaataaatttgctgtgaagggaagaatagagccgtgatagtatatagataattaagctgtagcctttggcctctaggacttacagtatacaagagggaaacaaaaacatattcagttattaaatatggttggccccccgtatctgtgggttctgcatctaagaattcaatcaaccatggattgaaaatattgggggaacaaagcaataaaattaatacaaacagaaaatacagtataacaactatttgcatagcatttacattgcattaggtattataagtaatttagagttgttttaaagtataccagaggatatgtgcagatacatgcaaataatataccattttatatgaagaacttgagcatctgcagattttggtgcgcgtgaggagtcttaaaaccaattccttgtgaattccaagagatgacttcagagtgtagtgaatgctagggtaaaggcagccttaggttctttgagaatacagaagagagacacttaatttttttgaaagggaagccctagtggtcaagaaaagccttacaagcttaataaagagactggatgggtacagctttagtttctctgcataatactgttctagacaagttgttttcttgtggcaaggtagattgacagattaatctgagtatttttctcaactttttatctctcttatcattttcttttcccactctcacctagcacaacacacactgaaatggaagcaaagatgaaggaaaattgccaagttaagtatgacataataattattttcttagatgccttctttcagagctggtttttggatactacagagtagtggcctgaggtaagatgaagcataatgctaagtaggaacagatttttaaattggcaggaaaagatagtttagagaaaaaagagaaatatttttgttaattaatagtagtattggttttaatactgttgttttattgcagagaatcaggctgaaaagttagaagggactcagatgatgagctggactcaaacatgaatattccttatcataactcatgtacaactgttttttttttttagcattcctgagtacttataaatctccctatacattgcaagagaaatggaacataaatgctttgtaaattgaataagatggaagtaaacttaatcaaagagaatatctctacaggctggggcaggagtgcgtcaatcactgcaaatcgaaacctcaatgccttcatctatgaatggctagtaataatattacctaccatagtgtcactgagaatgttagatgacataccactttaatacatctgcctagaggagaaatggatgtattctacctgaaaagaaatattatttatctggatgctcttcagtttttaaatataacagttccagtatttagtaaaaataaatactaggtatataagaaacatgactatataactgaacaagagaaaaatcagacaatagaaccagacacataaatgaccctcattttggaattagccaaccaggactttagaaggagtataatttatattttcaaaaaaagggaagagatagcttaatagataaagaatttcaataaaaatgaatgtattagagaatcaaataaaaattatatagatgaaaatgcaatatctgttattaggaatttagcagaatttaaattaggggactagaatgcaggctgatagagaatatctgacttgtagtttagaagtgataaaaaagatgagagataaagaatacagcaaaagtgatataaaatacagtgaaaagttatggaaataagcagaacaatgaggcttccccaggatgtccatatcctattctctaaaacctgtgaatgtgttatcttacatggcaaaaaatactgaagatgtgacttaattaaagatttggggatagagagaatatcctggattttgtgggtgaacctgatgtaatcacagggtctcttgtaaggaaaagaagaaagcagaaaagtaaaaagttagagacagagatgtgaagatgaatgcaatttctggcttggaagataaaaagagagccatcagctaaagaatgcagccagcctctagaaactggaacgggaaagttaaatgattctttcctagagcctccagaagggatatagctctgctgacatcttgatttgagcccataaaactcgttttggacttctgatctctagaactattaacataagataacaaatttgtgttgttttaagatactatgtttgtgataatttgataattatcttaattttatcttaatctgacaaatattgattatagaaaacccatagcaaatattcaattataacttattgaacacttacatattaggaataaaacaaggttatctgctatattgacttttagttcacatttactcaggtagtaaatagtacaataaagcaataaaaactaaagaaaaatgccaatctctaattttttacaaataatataatatgtacaatgaaaaatttggaagaaagcttagaaagatacaatgactgtgtggataagcaaaggttttttccaaacaaaacaaaatttactaaacataaaggaaattattaatacattcgactacattaaaatcaataatttctgttaatcaaaagagatcattaaaagtatgaaaaggcaggtcacagaattgagaaaaaaactgcaaaacaataactttcaaaggactcaaatcattctagatatatatctagaatatataaaaacttcttagaaacatataagagtagattaccaaataaaaagagcattggacaaaagacttgagacattttcacaaaacaagatgcccagaccatcaataaacatttgaagggggctcaactttgttagttatcagagatacacaaattaaaatgcaatgcaatacaacttcacagccactacattggctataatgaagtgaattgttggtaaggttgtggaaaaattggaacattacatatcaccagtgagactgcaaattgtacaatctctttggaaaacacattggcagtaactgctgtaacagtatatatggaaaccctatgaccagatattctatttctaaatatatcccccaaagaactgcatatatacatatatgataatcaaaagacatccatagtaaaatttatgtagaaaacgtataatagtcccaaactggaaaaaacctaaatgtttatcagtagcataacagataatactaaacttcattgataataaataaaataaaactacacacaaaataatgaataattttcacaagcacagtttaaaatacatattgtatcattgtacttatttgaagctcaaaaatagtcaaagcttatccttgctgttttaaacctcaacaatggtttcccatgatttgtttcttgttaagttttggttaaaatggcatgtttactttgtgaattcatacagacccaaacttataaactgtctatttttctttggtgttaaattgtaaataattataaaatatatatttaattttacactaaacattttagtagtctaaatgtcaatattgccattatggttaatgcttttgattgtaggtcctgtgaagagcaaaataatcaaaagtttcttttaccgtttttttttcatcttcaacttttattttaagttccagggtacatgggcaggatatgcaggtttgttacacaggtaaacatgtgtcatggtggtcagccgcacagatcaacccatcacctagatactaagcccaacatccattagctattcttcctgatgctttccctcctcctgcccctgccaacaggccccagagtgtgttgttcccctccatgtgtctatgtgttctcattgttcagctcccagttataactgagaacatgtgctgtttggttttctgttcccgcattagtttgctgaggatagtggcttccagctccatcatgtcaatgcaaagaacatgatcgtgttcctttttatggcttcatagtattccatggtgtttatgtatcatattttctttatccagtctatcattgatgggcttctgtgttgatttcttatctttgctattgtgaatagtgctgcaattaacacacacgtgcatgtatctttataatagaatgatttatatttctttggtatatacccagtaatggattgctgggtcaaatggtatttctgcttctaaatctttgaggatcttctacagtggtttaactaatttacatttccaccaacagtgtaaaagcattcccttttctccgcatccccaccagcatctgttgtttctcaactaattgccattctgactggcatgagagggtatctcattgtggttctgatttgcatttcactaatgatcagtgttgttgagctttctttcatatgtttgttggccacatgaatgccttcttttgagaagtgtctgttaatgtcttttgcccactttttaatagggttttttttttcctgttaatttgtttaagttccttgtagactctggatatttgactttgtcagatggagcaaaaattttctcccattctgtaggttgtctcttcactctgcacggtttcttttgctgtgcagaggatcttgagtttaattagatgccatttgtcaatttttgctttttttttgcaattgcttttggcattttcatcatgaagtctttgcccatgcctatgtcctgaatggtattgcctggattttcttctagagtttttaaagttctgggttttacattcaagtctttaatccaacttgagttaatttttgtataagggttaaggaaagggtccagtttcaattttctgcatatggctagccagttctcccagacccatttgttaagtaggtaatcctttccccattgcttgtttttgtcaggcttgttaaagatcagatggttgtaggtgtatggtcttatttctgagttctctattctgttccattggtctatgtgtcttaccagaaccatgtattttggtcattgtagacctgcagtatagtttgaagtcaggtagcataatagctccagctttattctttttgcttagggttgtcttggctatttgggctcctgtttggttccatgtgaattttaaaatatttttttcttattctgtgaagaatgttaatggtagtttaatgggaataccattgaatctatgaattactatggacagtatggccattttcacaatattgattctttctatccatgagcatgaaatgttttcccatttgtgtctactctgattttcctgagcagtggtttgtagttctccttgaagaggtccttcatttcccttgttagctgtattcctaggtattttattctctttgtagcagttgtgaatgggagttcattcattatttgtctctctgtttgcctattgtgcaagttgattttgtatcctgagacttcaccaaagttgcttatcagcttaagaagatttggggctgacacaataggtttttctagatatagaattatattatctgctaataaagataattttacttcctttcttcttatttggaagccttttcttttttctcttgcctgattgccctggtcagaacttccaacactatgttgaacagcagtggtgagagagggcatcctcgtcttgtgccggttttcaaggggaatgcttccagcttttgctgatacagtatgatattggctgtgggtttgtcatatatggctcttattattttgaagcatgttccttcaaaacctagtttactgagagttttttttttaacataaagggatgttgaattatattcaaaggcctttctgcatcttttgagagaatcgtgtggtttttgtctttagttcagattatgttatgaattacatgttttgatttgtgtgtgttgaaccaaccttgcatctcgggcatgaaagcaacttgatcttggcagatattctttttgatgtgctgctggattcagtttgccagtatttaaatgaggatttttgcatcgatgttcatcaagattattggccagaagttttcttttttgttgttgtatctctgccaggtttttgtatcaggatgatgctgtcctcataaaaccagttagggagaagtcccttaattttaagtgttaagaatagtttcagaagaaatggtaccagctcctccttgttcctctgatagaattaagctgtaaatcagtccagtcttcagctttttttggttggtaggctacttattactgcctcaattttataactcattcttggtctattaagggatttagcttcttcctgattcagtcttgggagggtgtatgtatacaggaatttatccattttttctagatttttttttagtttatttgcatagaggtgtttatagtattctctaacggttgttatatctgtgggttcattggtgatagtccccttattatttctgattgtatttgtttcttctctcttttctcctttatttgtctagctaatagtctattttattaattttttcaaaaactcctctcctggattcactgagtttttgaagggtttgttgtgtctctatctccttcagttccactctgatcttagttctctagttatttaagttgtcatgttaggttgtcgatttgagatctttctacctttgatctttgaggttgctaacctttggatggggtttttgtggaatctttgttgttgttgtgttttctgtttattttgttttaacagtcaggcccctcttctgtagggctgctgcagtttgctgggggtctgctccagaccctaattgcctgggtccctcctgcacctggaggtatcaccagtggaggctgaaaaacagcaaagatggcagtctgctccttcttctggaagctctgtcccagaggggcattgacttgatgccggcctgaacgaggtgtaggaggtgtctggagggggtgtctggaggaggtgtctggagacctgtaggaggtgtctggagactctgttgggtggtctcacccagtccggaagaataggattaggggcctgtttaaagaaagagtctgggtaccccctggcaaagtgggtgcactgtgctgtggggaaccctccctgtccagacccccagactctccagagccagcaggcaggtaaggctgagttgactgaaccacagagaccatggctgtccctcccctgagggtctccgtctcagggagattagagttctatttgtaaaactctggctggagttgctgaaattcctgcagggaggccctgcccagtgaggatagatagtttgctgtcccatttaaataggcaatctggccacaatctgccacagcagctgtgctgtgcagtggggaatttcttccagtccaaaccagccagaatccccagagccagcagaccaggacagccaactggagccacagagatagtggcctcccttccgcccaggaatttggtcatctcaggcatctccagcctgctgctgatggctgtctggaattccaagcctgtgggccttaacttacgaggtgttgtaggagtggggcctgcagaatgatgccacttggctccctggcttcagcccccttcgtaggggaatggatggatctcctgcctcattgaattcccttggctccctggcttcagccacgttccgtgtgtctttgtgcatgcctgagctgccaccaagagtttgaatagctctgtgtttcggacccaaggccctggtgacgtgggctcacaaggggatctcctgatctgcaggttacaaagatccatcggaaaagcatggtttcctcgcatgatcactcactgcctcccttggcttggggtgggagctcccattgctccatgcggctcctgggtgggctgttgtcccaccctgcttttccttgctttctgtgggtcatgccaaccacctaatcagttccaatgtgagaatatggatacctcagttgaaggtgtagaattcaattgctattttcctttttctctgtgagagctgcaggctgtatttgcttctaattggccatcttggcctgtcctacttaatctcttttattcttgattttatatttagcaattttatttgttttaaatttcttgtactggtaccccaaaacaaaaaaatttagtattaaaatgacatttatgcaacaaattttcctttaatttcattattgttaacactgaactctaataactcaaataatatgaaagcctggcatgtcaaaacacaagaaaatttcaaaacaaaaggaaacatggtctcatgaataaaagaattgtaagtataggtcgggcacagtggctcatgcctgtaatcccagcactttgggaggccgaggcaggcagatcatgagctcaggagattgagaccatcctacacggtgaaaccctgtctctactaaaaaatagaaaaaaaattagccaggcgtggtggcgggcacctgtagtcctagctcctagggaggctgagtcaagcaggagaatggtgtgaaaccaggaggcgaagcttgcagtgagctgagattgcgccactgcactccagcctgcgtgacagagtgagactctgtctcaaaaaaaaaaaaaaaagaattgtaagtatagctgctgagaaatggtaatatgtacatgctaccaagatgaatatgcagttttgtacggaaaataatcaagagtttcacttagcctcaataatttctagctgattgagttgtattgtgaattcagatgatgcatgccattttaccttatatcataaacattatgtacatgtttctgtttctttactagaatatatatccagagaaactgcccacttccaaactttcagggatgctggatacaattgaacattcttttaaattgtaggcttaatttcagtaagtgaatgaaaaatctgttggcaacaaataccaagagtgagctgcagtgatacgctaacttgggagcatgattccctcaatatttgttatctctttgacttagagactgagatcttatagcagcctctaggtaaacatggaagtggaatggattaggtgtgggtgcaattaggactccttgggctttcccagcatagagaattgtatccttaaagctccagtcttcacatctttagtaaaataggactagaaaaaaaaaatctgccaacctatcaaaagaaaaacaaaacaaaacaaaactggaagtgatctaattcagcttgggcgccaggaggttttgtttgtttgttgtttgtttgtttgtttttgtttttttttggtgtgtgtgactcctctcagaaaatctaaccacatccctgacacactgcaagtttaaagttcaaatttacattacccttgtgttctggcaaattacagcctggtaaattaaacagtcactgattagtagtacttcaatctaattcttgttagcaaaatatgtggaatctaccttcagaatacatttgatataaagccagttctcacaatctctcccaataccattctactcttagcaccataatctctcctctagatcactgttgttgctgcatacaagtttctttgaacttgattcgtttatttattctcaacaaagacagatggtgccactcatctgctcgaaactcagtgttttcctatctcatacagaataaactcccagaccttaaccatggtcttctaggcaccttgcccaggctcctccagatctgatcccctgctgcttttctgatcccatttctttccaggcttcccctccttcacttctgtaccatgcacactgacatatgctgttcttgggaaacgccaggcaagttcctacctcataacttttgactagtccttttgcctggaacactcttcctcagtaattcttatgattatctttctcttcttcagatctctgctcaattagcatctgttttaggttgaactatgcacacccccattcatatgttgaagtcttaaccccccgtatctaagcatttgatcttatttggaaattgggttgttgcagatgtagttatgttccaatgaaatcattagggtgggccctaatccaatgtaactggtgtccttacatagaaaggggaggcttggaagacaaacattcaggggaaatgccaaatgaatagaaagacagccatctgcaagttaaggatagattcctgaaacagatccttctttcacagtccttagaaggtaacaaccctgctgacaccttcatcttggatttccaaggtccagaactgtgagacaatacttttctcttgtttgagctacctagtttgtagaactctgttacaacatccctaggaaatgaatacatcctctaatgaaagaggacttccctcagcacttgatattaattaaaactatgactctattactctctctcttgttttttgaattatttattcttggcatctgtttctgtctccttatcacaaaaatggaagctcccaagtgggaaactttgcctgcattatctgttattattaacaattgtgcatgaaaaaaatagaaaacttgaatagaccttcaagaaataacttaaaactaattcatacatgcttctccaaatgaacaaacaaaaaacttaaaagcaaaactagactcaatgtcaaatattccaggaatagattattgacattttattaaaaatcccttaaggaaaaaaacacattaattatatccatcttcttttaggagtttgatatacattagatactgaaaacatgaaagtgcaccttgttatttgtgtttacaaaacctgtgtagtattcgttatgtgctaggcattattctaaacacttactgactcatttaatccttctaacaaccaattgaagtaggtactcctcctgttcccattttgcgtataagaagttgaaggaacggaaaattttagtaatttttctgagataacaatgacagtaattggtagtgaatgaacttgaatgcaaacaacctgactctagaatccatgctttaaagcattaaactgtgctgctttcaaatagaaattaactacagggcaatttcacttactagtacatgtacaaataactttaaattatactatgtaaccaaatctaataatgtctcaaaaggaaacactttatgattgagatagtcatattctagtatttcaagaattatttaatatttgaaaattattaatgtaatacacaaagtatcattaaatgagaaagcaatatgttcatcttttcatatgtggaaaatacttttacataattcagcatttattcataattacaaaaaatctcagcaaatactgggaaaaaatgtctcctaaaatctcagcaaacttgatgaaataagtgttttcttttaaatcagagaaatgacaaggatgcctgctgtagccatttttattcaacattatgctcaaattcctaaccagtgatataatataataaaaataataaaagctattaagatttggaaagtaagaaacaaaattgtcaatatgctcactcaatgtgtttgtatactttgaaaattcaagagaaaaatatttgaaattgataagtgcattcagcaagatagctatatataagatcataagtctattcctatacacaacaaaacaagatgatataaaaacaatgaaaactataaagcattcagtaataaatataaagaaagtgtgtatgatgtttaggataagttataaaattttactgaaaagcattaaagagttaagtacagaaatatttcatgtccatggctggaaagtcttaatgatacatatagaataataccatcctaatttatatattaatttaatgagtagaaatcaaaattctgtcttaatttttatggaatttgcaagttgtttataccaattgtaaggtaattgaaagggccaagaattattgaaaaaatttaagaaaaagaatatgttggtgggtattttccactcagatgtcaaaaataacttatgctatttgtttagaaagatagataagtgtactaatggaagagaacaggcaaaataaaaaaaattgtacacatattaagccgtgctttatgttagatacagcactatagatcaatgagggaaataattgatttatacacagataatgatgatgaaattagttacccacatgaaacaaataaaaaatatatttacctcttaccatgccacaaaaccaattctagaggggatgaaaatctaatcagccacaatgtatacatatttcaaaacatcatgttgtataccatatatctatataattttattgtcaattaaaaacttaatttgtcaattaaaaaacttaatttgtcaattaaaaatttacaaaaaagaaaacataattagagcaaaatgttacaatggggaatgtctgatttccaaaagacaatacttaaaataagtaaaatggtaatacccaaggtccacagtccaggggaagttaattgcagaatacacaaatgcctagcagtagtattagaatatctaaattaaaaaaaccttggccaagatttaaatataacatatagaatagtgctgaatagaaaacagaaaatattctatctacttttatatatatgtgtatgtatatatatacacatataaagaaggttattaacatcaaaaggaggcacacagaagactaaatgtataggtaatatcttatttcttttttgaattttattttaattgacaataatttttatatagttctggggtacaatgtgatgttttgatatatgtttacaatgtggaatgactaaatcaggctaattaacaattctatcacctcacatacttaccttttttttggtgatgaaaacacccaaaatatactctttaagcagctttgaaataaacaatgcatcattatttattatagccaatattctgtgaaatagataactaaaacttattcttcctatctaactgaattattccttaagtgactgctgagaacatggacctcatgatatttatataccgtatatattatttcactgaaatattttataaattttttaatgtagacaaaggatactgtgtgtttaaaaatgctgaatgacttgcaggtcacactctgttttgttcaactttgtatctccagatcctgacatgaaatatttctcagataatttgttcatatgagattgtgaaagagtaacagtcatttaaattatgataaaaaatttaattaaattactataaaagaaatttatcttaagaagaaaataaagaggtgataggtgaaagtaatatatatccaaggataatataaacatttacagagaaggattggggttcaggagacctcattccaaatctgaccatatgaccatacactaactcacagagtaattttgggcatgttgtttctggtggattaacatttatcacaaattctttgacatcccttttactcagaagtggagttccttctccacccctggttctgggctggcctttgactgatttgtccagtgaaatatggcagaaatgacgccctcccagttactaccctagtctttaagaggactgacaagcttcaccttggtctccggaagtcctaagctagctactatataagaagttcagctacctagccagagagaagacatagagatcccctgagactacagggagagggagaagggccaatttgagcccagctttctaactatctctgtaaaggtgcaggcatgtaattgaagctgtgttggacccctctaccccagctcgaacatcagctaaatacctctgagtaatccctaaggatggcatataaagccaaattgcctagccaacttggcagcttggactgctgtttactaatggcttttttcttaaagaatatatttcacattgtttgaacatgaccacttaaatgggttgtaattcctagtcacaacagaaatttattcaacagaaatggtgtttatggagctacttctgttcagactggctttttcttgcccgtaaaatcatgagatataaaagtatagtttttgtttgaagccagtatgtgtttagtagtttgtaaatgcagcaatagatagctggaactgaatttattacctggaagtgggatgctgctgtaacaaaaacctaaagcgtgtggaccaggcagtaggtagatgcttggaggacctcaagtagactgacagtgaaagcttagaagtagatggggccctgagggacagtgaggaaagggtatttgatggccagattaaaggttatccttgttatacagtggtggaaggtttagcaatgctgttacctatagtaatatgaacgatgggaaataacacctagtggcttaatgatctaagatgatttctatgcagaatttgtaaagagccaacttagttctggtggcctctgatatatgtactaaagaaggaactgttaagttttcaagttaaatttggagaaatacaatgtattcagaacagtctttctagccagcaaagagttatcaaaagaagaaatagtctcaggtgaaagatgaaatccagagccatgaaacatgatatcagggaatagatgtaaggctgtaacaaactttgctaagacttcagaccctcttcgctgcataatagattggtgctttcagaatctcgggagttttctacagctacattgcagacaacccaaccaaagcctatctcagaaaaatatagttgtaagactttttttcctaatgaaatgaacaccaataaagctcagagtaaagccacagagtttctgttcgtttgtttgttttttaaacaattgcattggcagaagcaccactagcttagatcaaaagggagagcagtagttcagaagaagttggagtttccaactttcagtgagcaggaagctgactgatagggctattcaggtattgacattggccatctttttttttcaatgtaagagggaagatgattcagaaggcagaatatagagcccagataatgaagccaagattgcagagaatctgtcacagggagcaggactgggttctaactaatgaattaggaatattgtatgaatggatttcagaatttctatagcctattgattgttatatgcttcctcttcccttctttttgaaaatgcatgtttatcacagttttcttatgcccccctttttattgtattttatgtgtgtgtgttggggatggggaatataacttatgtctttaattcaaaaattttgcattaacaggaatcttattcagggagtctcatccacatctgacctaatttagataacgagacactggatatcaagtcaattttaaaataagataagactttgggggatcctgtgaggagttaaggagttgcatgagaaaattgaataatttatgaacagagtgagaactatggcatattaaaaatggcaaaaattatttgacactcattccaatgagtggttatgttggtttccccaccatttgaatcagactagtaaatgactacgttgaataatgagtatgactaataatattgcatattctgggcctattctttaaaagaactgtcttgatctctggaagttctgggtttccatgcaataggtccagctaccctgctggagagaaccaacgagagactttgagactatgtagggaagaaacgtacacctgttttcaaccttccaacattcctgtcaagttaccaggcatatgagtatagctgtcttagaaaatgcctgatttcatgacccacaaaacagtttgatacaaatcgttattaaacgactaccttttggggtatttttacaccgcaacagataattagatggacagataggtaggtagtcagctagctagcaagatagataagcaacttagtatcagaatcctgttagtatagctgtaaaaatagagatgtttcaattacattatttctgacctaaacactctaattcataaagttaagaatttactccagtttcttctgtccattttgaagcattttctcaggcattttggtaaaatctctaggccaaataatagagaacagaataaataattaaatcattgctaggcattaattatggcaaagatatttggacaactgcctctcagtttaaaccagctgaactgtgacaatgcacatgattttaaaaagaccttcattgtagttcatgctctattttctaagagaaaggtgtctgtcccctgacacttcttaaaataatcacagtgaaacagagactaagctcctgggatatatattaattaccctgtagtataggagctgagattccctggagatgaggacaaattgtgaagggtcagtttcaaagtaagtattatgaggtagattagaaaacaactgttttcttagagaataaatttagcattatttggtcattattaattaaacttgtaaatgctaatcataagcaaattagccaacatatatgcttttaagcgtgtaatttctgctcactttttttctgagaaattttattgtggaatatcaattatatatatatatttctccacgaattagagggcgcaagttcagcataccaattctatgatgatttatatgagattaacagatgattatcaagggcttactttatgttttggtacagtgcttgctagtgtctatgattgtccatgaaattctgggcaatattttaaggtctaaaaaaattaactcaagctttatatttttataaactataacttcctactgtatttatagatagtaaaagggttaaatgcaccatcggtttcttctccttgaaaattctgaacacctgaaaggtcagcacaaaaatggtagcaaaacagatacaaaaaatgcaagatgtcaaatataaactttaatttctgatctgtggaatcaaacacactcactgggtcacaattgtaaattcaagactgtaaacaactcattgcattttctgataactgaagtgacaaattgctaacttgaacaagcatcaatgttgttagtccagattttggcatttgcacttgaataaaatttttcctttcattcagtgggagcccaaatgaagctcctgtctttaaagtttatttttccttaaaatcttcttatttaaataaaacttaaataaaaacttatctacaataaactgaaaagttaaaaagctgagagatgcttgaaatatatatatgtttgaaataaacacacacacacacacacacacacacacacacacacacactagaataagctcttcatggagccacaaagaggcatctatttatttatgatttctgggtgtctttcatgatttattttcaaacatgacttacacttgcactcagaaatatactattgttttctttctaaaagtattaattggattaaatagaacattaaatagaacattttatattttctattgtaattgctttttgatttttatatataattatctacataaatgaatatactgaattctccctgattaatatttttgagtagctattacttcaaatagtaaataggaatagtgaagaatgcagttatgtgaaagaaaagattccatcacacatagagctttaaataaatagttttaaagtttatgtgtatattgtataagtgcttatgaattttatagttaaggatattccttaatatactgttttgaaaagatgagtttgtgtgttttttaattatctttattctttagctaaacaggaagctatagagagaaggggaaagatggaaaaaaatcaacaaaatgcactcataatgatcttttttcatagtaacaagatacttataatggataatctcaaataactgataatcttgtagatatgcaaggtatataatataatttgtaaaaaagggacacacatgcgcacatttgaacatatgcttttttcctctctaatttaaaatagaattcaaatttaatataagccaaacagaaacaactctctaaatgccactaaattctcaaagtttagccagtaagaaatatcagctattaaataaaggtgctcatatctaatatattggatcataggaagaagtttctgaagatacatttacaaagtaaaatgctgaaacccccttcacttcaaaatgcatgcttaatgctactgggtcaatgcccttggaccaagacactgtgaagccacacaaaaaaatcagcagaaataggtctttataaaaaggagcagtctaataagagtgaaaaatgtgaacaaaatgtaataacacaatatcgaatgtgaaaggtttcagttagagacatataacatttcacaggagctaccagaaggaaaatattgctttacttgtaaaagatcctgcaaacttcctttcaaaaatctgatgagatatttttggaggagtagggaagggagtagcgggcaaagactgccagtgatctttgaagctgtttgggtaaaggccacacctgctctgctgtggaggaaactttagcagggcacatgcattccagacagatctgtcttttgagagaccacaagaccaagaatactgtcacaaggaggagaggaacatcactgagtcaggtgtcaaaccgtgagctgcaagatttatagtcaatacaagtgttccttcctcatccatttggtacttgagttcagatcatgagtttaagtagtgtgagtttggatatacagggatatttgcactgcatttttcacattgcaaaagtcagctttatatggtataatttgcacacattaacattgaaaaaaagaaaaccctgcaaagcataaggacatttgcattactctgtatagttacatggtaactctttatagttcatttcctccactacccatagaacctttcaaccaatgacttgctttttgttattacaatgttgccttatgtagaatttcaaataaacaaaatcatacggtatgtactttctccatgtctttttcatttagcgtaatgcttttaagattcacccatgtatttgtgtttcccagcggtttgttacattgattgcttagtttctttttgaactgattctattgcatgaatatattacaattcatttacccactcaccagttcaaaggtgttgggattgtttatcctgttattaataaaactatgatcattcaaacataacttttttgtggacaagtgtgttttcctggaaatgaaatagctgggtcatatgataagtgtacattgagctttatgacattgacaaactgctatccaccatggctgtacaggtttgcatacctgccagcaacgtaagaagagtttcagttgcctcacatttttttgtcaaaacatggtgttttcattcttctaaatttgaaccgttctaatttttttagaaatatcttattgtggttttttttagttctctaatgactaatgatgttgagcatattttaggtgcttatgtattcatttacatcttttgtccagttaaattttttggcctaatattgagttataagggtttattatatattttatatacaagccattaagaaaatatatgatttgtaaatattttcttctagtgtgtggcttagattttcattttcttaatggtatttttgaaatgcaaaagttttaagttttaatgaagttcaatttatcaggtttttttcttttttatggattgtacttttggtgtcatatatgaaaactcattgcctaacaaaggtcatgaagattttgtccttctttcttcaaagaattttatagttttagctcttacatttaaatccatgatccattttgatttaatttttgcatattttgagttaagcgaattcatctttttgtctatggttatccaattgtcccagcaccatttgttgaaaagattacactttacccattgaattttcttggcatcttactcaaattcaattcaccatggatgtaagagtttatatctagattctcaactctgttccattgtattatgtaaggttttttttttgtgtgctaaaattataccttgattataatagctttttaataattttaaaattggaaagcattaagtcttacagtcttttctcaacattattttggatattctgggctgtttacatttccatatacattttagaatcagcttgccaatttctgcagaaaagcctgctatgattttgaaaagtattctaataactgtgtattaatttgtagagaatttccattttaagttattcttccaatcaagtgacatactgtacctctctatttgttttggtctttttaaatctcccctaaaaatattttacagttttcagtcctttcacatattttgataagattatctttaagtggtacataatattttatgttaaccagtaaatggtatttttaattttcaatttccatttttgttgttagcatttagacataaattaatttttacataaaaattgccttgaatatttcccctccctacacttgctatttctaatagctttttaatagattccttataatttactttgtgtatgttcaggttatctgaattaagacagttttattttttcctttccaatatttatgttttctttcttcttttattttctgtgttttcaccttatactggctagaccttccattattaagatgaatagaggtggtgagagaaaatctttgccttattcctgaagtcataggcaagcattcaaacttccaacttgcaatataattttagcattggttttccataaatcttattgactaggttgaaaaaaatcaccttctattgctacataggtgatagattttaaaatcaggaatagatgttggattttttgaagtgcttttccacatttattaaggtagttatgttgattcttttccagtctgaaaatatagtgaattatattgattgctcttagaatattaaattaacctgtattcctgagataaggctgacttggaatggtgcataatattttaaatatattgtttgatttaatatgccaacattcgtttgtaaaattttatcccatgttcatgagacatatctgtctgtagttttcatgtaatgtcttttcctagttttgatataaaggtaatgctgactccacagaattggagggaaaatctttcttcctttgttatattctgaaagagcttgtgtaaaatctaatagcttggttttgttttgtaacattctttaaaacactttttgttttgtttgctttgttacattcttttctgcctttttttaatctcatgtcagtaggcccatgatagatcttcaacttggctttcctccattaggtcactgaatgctcttaagtaagttgtgtttttttatttgttggttcataattttgtgattccttagaacacaaaattgttctaaggaatcgtgaagatcaaattgttgacaagcagagtagcatctcctcttttgagctgacatccaatgagcagaaaaatccagtccctctctagcaacaggtctcccaacgtgtgtagcaagaaagtttgctccactgcagaatctgggagctacttggctcaccagagcaactttcctgcaaatccatagccaacaggtgggtgtagagtcctgactcctcaaaaaatccacaccaggagctgtttgcttgtttgtttatccaacaaggggtagcaggcactcttctctgtagctagtcatttattcaatcattcaacaaatatttatgaaaacctactgtgttagaaagtattcctagcacatagaacacaccaggaagcaaactgaaaaagatctctgtgctcttggagtttattggggtttaaaggtgatgaaccataaatataataaattattaaataatatggtatgccaaaaagtggtaaatgctgtcaaaagaagaaaagtatgacagtaaaaaagacctcaaattttagggagagaaagtttgctgtattaaatgggatacttaggagattcttctcattgagaagatattagagaagacttgaagggcatgagcaatggaatcaagtgactttctagggaagagcattccagggagcgggaatagctatggctaaggcttcaaggcaaggcacatgcccctctctgcattctggcatcaaggaagaggtccatcctctactcatcctctgaggatttaggctctgccatcattcatagccttgtttccttcccagtgggaggtgagaagaagagggagtcacagttgtattcagaacttgactcagcttttcagagttcctctcctacgaagtatgcattggaggcactgtccaataatgaatactagcccagcttgtcactttaatattccagaatgagacacataggaaaccaattaatatgtcactgacagagactattgtatatcattttaaggtaggacagtcctgatgacaaatagcataacacaagcaaaatgataattagtgtttgatttgttgctgaaaacgcctgcacagaattgctcctttttttttttttaactttaaaatagccaagcagaacagcttatctaaatgcaaaaaatgcattatttatgattggttttcatctattcaaagatatcagattttaagttcctgtagtatccttgggatccgtctatcttgggatccatcaagaacattgggaagtaagataaacctgaaggcagtatcatttataaaaaaaatataacatcgaggccttgaatattcaacaatttatatacctggcattttctttattaaaaatgtattcctctatattttcttcttagtatctgattaatatcttagtacctgattattatcataatctagtactgatgggttgaattgtttcttttcttttgtaacaactggaataatttgtcgatctttcaagtctttcaaatgcaaaacatgaaataaaaattacattacatcataaaaattacagtagttggtttgacagctattttaaagttaaacctgtatttttcaataaatttccaaacctttttgtggtatcgaaatgtacatattatgtaatacatgtaattttaaacattatgtaaaatttcctttgaaatgttttaaatacaaatgtgaaatgttttaaatacaaatgtgtatgcatacatatgaacacatatgcattaaatacatgtatatattcatggcaaagtcattgaatacacttcagacctagtcttactttggttctgaataataataagcatttaaaatgtacatacatgattttccagggcaagaattttcacatttgaaaggagaattgtattaatattagaccttttatataaaataatagatacgttaattattgtatgaacctgggcatatttattgttcactaaagatttagaggtatgtttgtgtctcactcaagtttttatcgagccaatcagaaaagttgtaacattctggctaagaaatccagttggatttagtaaaaatttatttatacaaagttccaagaaccctaagtgtttcatttttagaaaacaaatttaaataaaattgctttgggcaaacatgtgaataaatcaaaccaagtgaacataaaaaatggcacaaaggtcaatagaagtgagagtataacatttttttaaaaatacagattaatgagaagatagcaacctaaaacatttttaaatgctttttagttctaagacccatttattagctttctagggctgccataacaaagtaccacatattggatggcttaaacaacagaaatttattatcttacagttctggaggtcagaagtacaaaatcaaggagtcaagaggtttgattccttctgagggcttgttagcagtggtgaatccatacgggcgagtctgcagtgactcctcgaaggaaagaatttatctgaggggcataaggcagagtgagagagtgaggcaagttttagagcaagagtgcaagtttgttaaaaagttttagagaaggaatgaagggaagtaaatttcagttggaagagggccaagcaggcaactggagtgatccaagtgccctgtttggcctttgacttgggcttttatacattgtcatggttccagggcttttgtacctctcctctctccggttttccttggggtgggctgactgcatgtatagtggcctgccagcatttaggaggggctgcatgtgcagtgtgtttactgaagttgtacatgtgctcatctgaggtgtttttcccttaccagatgaatgttcctatgggaagatcatataccagttaaactctgcaattttcctcttagtgcacatgcttgagcccactcaagagggaaaaaaataatctcttgatttgcagtttatgaattctgcagctactaattcatcttgaaagacttcaaatttaagcaagcttcataaatatactgatagtgaatgtgttctgagatctcaccaggaagttggtgatcaccagcttcaggtgttttctatccatagggagactgcctttccctagcaccagctgcaaccaattattattttagagatacagttgaacaacggcctggccatcacctgatggtcacctgacattcctggggctctcctgccctgctcatgtctgcctagttacctactctaacaggctgtgagggaagaatctaggcctctacccttggcttaaagatgatcatcttctctctgtgtcttttcacattgtctttccgtaatgtgtatcttgactttgtgtacaaatttttcctttttatatggataccagttatattgtcttaagagtccacaataatgagctcgttttaacttgatctcctttgtaatgaccctatctccaaataaggtcagacactgggagttagatctccaacatatctttttttttttcctttgggagaaacaattcatcctgtaatatcttagaaaatcaaaatagaacaaaattaatattgcacaatttcacttagcacacaaattataaagttagctattaacttgaagcagcatattacacaaattgtcatactcacaaagtgtttcctcatctaaggctacatacttttgcctagtgtttttgtttgtctagtttgtttgtttctctgtcagaatctcactatccaaatcacctattctcacttagagcagagttggaacacatgtgattaaactgagagaatccactccaataattagagaagattatatcaactgtttctgcctcatggacacagggaaaaaattgtctgtctggttgaacacactcactaccagtatatttacaaagcttacttatatttgaagtctttcaagatgaattagtaactacagaattcataaactgaaaatcaagggataatttttccttctatttgcattaatctttctcactactataaaaaagaatgtgtttttatttatgttatactatcttagtaatgcagctaaacagaaaaaatggcaattatattatttacatccccaaattctcaacccagcagacttattttgcttttatcctctttcttgagtaagttttgatcaagacatccttaatgttctcctcaacttgactaaattttagacaggcttctttttgactataggcctcttacctccatttcctttgagcctggagtgcagtggcatgacctcggctcactgcaaactccacctcccgggttcgcaccattctactgcctcagcctcccgagtagctgggactacaggtgcctgccaccatgcctggctaattttttttgtatttttattagagttggggtttcacctgtgttagccaggatggtctcaaactcctgaccttgtgatccactcacctcagcctcccaaagtgctgggattacaggcatgagccaccgctcctggcaggagttgtaaattctttctctgctcttttgagatgtaaatcttctataacccaggagtgtctttctctaggacctgggagccattcctttgaaacataatcaagaaaggtagggcccttgtcttccaacccctctggaaggtaaaagcctggtttccgtaaataacaatttgcaaacataggtgtttgaatcacattgatcaacatccccaccccttcatccacaccctccattcttcagtacttttccattagctcacctgagcatttaaaaaatcctcctgctttttgtttcagggaagttgagttcaagctcaacttttattccaatagtctttgtccctaattgcaatggtcttgaataaaatcttccttgccatttttaacaagtttccagtgcaatctttctttttaatagttttgtctgggcctatattgcgagtaaatatatatgaataagagaagctacataattttaccttattctataatcaaattgactacaatattacatttcattttaatgttaaggctatgaaaggcctgaaattacttggtatcataaacataatttctgtgatctatttatatattctgcttttgctatattccatgcaatattttgattatttctatttcatgataaagccaggaagatatttgatgatgatttcaaatatacaaagtttttctacacagaattctgaaattcctatctatttgcgacctagatatttcttgagttctgtctctctgttcaatttctataactacttatatatttaaaatctgcatctcttttgtctagaccagacatgttttacttgaatttgcagtttctacctaatactactcaaatccttttttccacaatgcaaaaggataatctctcctacttggaaatcataatatgtaattgtcagggccaccactgccctacatggtagctttgtgaattagaaaaagggtcttttccttcaagtcaaatagaatttaagtcagtagactacgacctaaataactatccttgggataatccagggaaagtgggaacttgggctgttctctcttgatggttgaggatgggagtgcttgttggttggcaagagaaaagtggaaaacttcaatgtatagagcaggctgtcccattttaaccaattagccattactgtaacagcaatagaagggcagctggctttctatgctttctggtatgatacatatgaaccagtataatctatgaagtagtcttggcaaaatgattgtaatcagcacttacttttaggtctaacttctagttaacagaaaatatagacaacaaagctataagttaaacatcgtcaaaagaacacaagcaggcaaatttaaaaggtaagacattctataggacaactggccttctatctttaataatggatgccgtgaagaaaaggatttgtggtaggttaaaattcatttaaaagctacagtgaccacacatggcatagctcatgactggttactgactgattgattaaactaatgagctatatttgttgaggcccctgggaaaatctgaatataaacttgtcattaaatgctattttgggattattgccagctttgttaggttagataataatattgtcagtatgtaataaaatatacttacttaggagcgaaatgtgataatagctgcaatttacttttaaaaacttctgtgaaaaaatagttgaagaaattatggcaatgtataaacaattgttaaatttacatgctgtcatagacatgtaattatgttatgcagtcttttgacttttacatatagttggaattctttataataaattgtcaaaatactgtagtactttaaaaattatgaatgtaaagctacagtttcagttctgacgtgtaaagaacttggaagttgtcattcccactcttttagcaaataataggaagaaaaagcttggaataaaagactttcgttggagccattagataattgactttgaaggttaaataatcagccaaatttagaaagacaggtgttatccagagagatacagatgagacttcttactttgaccagaagatactggagctataaactgggagaaacatataaataataattttggaaaacttctgaaaattatagaattctccccttgcctattgcttatcaacatagcaacaagactcttgtgtaataactggattatagctgaaagagctggaaggccagatctctatatgaggaggagttcttagggaaacacacagagaaacagggaacaaaaacaaggacattagagaaactcaaagtctatggtacctagagctacagcaaatattaaacacagcccaaccctcacagaaattaacataaatcctcacactgttaagcttggtttctgttacccaatatatcatgtctggcttaaaaaaattcgaagccatgacgaaagtcaagaaaaattctgtctgaaaaaacacagcaatcatcagaaccagattcatatgtgacaaagatgttgcaattatcatgtagaaaatgtaaaataactataaatatatttagggctatagttaaaaagtagacatgtaagcatgcatgagtaatttaatcatacaaatgtataatctaagaaagaatcaaaagaatgtgctagaaataataattaaaaacaaactataaagaaggctttcgtaggtttatcagtagactcatacaactaattaatgactcttatttacccgttaatattcattcatttcacagctctagcttagccattactttttaaaaaatacattctctagtgaatatatccctccatgttttattacctcattgactgactacccatctcttagggcatcacatacaccaggctttttatgaccatggtgtatgcaatattgatcatcttgttattatcattttttatgagtcaaggctaactcagcataatgccaaaatatgctgaagaattgtcagtaaattggatattttccgaagctctaaatgtctatattaaagaggtcaaacatctgagatatctaatttactttttaaatcattgtttggcatccagagatcaatatttagaaaacttctctaaagccactctaagttataatacaagagttgtagttcaaaaaagaatataaattttgattagaataagctaataatggaatatgcatctaatttttttatccaaagaaaacaactcttagacatattatttgaaatgcaaaagatagctttaaataatgaatgtttattttcttcccctaggtttgaccttaataaactttaagagacaattctccttaggtctctcatgtttctgcacatcttgtgagcagagacactgactttcattgttctgaactatattttcaaggacacttctatagtgaacaactttgaaagacataatgtttccctccagagcaaagtacaaatggaattatgctcattagaaaagactcaggatctttaagatcatggttcatcccctgtaatataatccattatgtgtgcagttatcacctgccctctgcattgccatataggaattcaggctcagaaactcagccaaatgctgatagtctgactgcagctattgctatgagtaatatactgtcctttgtctccaatccaggagtctcaagtcttctgccagaattcatgatacgatagtaaactaacttgtaagcttgcaagtattgtaaaatatcatgtccttcacagttcttaacatatactagagaaaaaaaaaatgctttcatttgtgaccgggagctgctttctaagcagtaactaatcaggtcaggcatgaattcttctgaaactattagtaataacataactcatgaaagaagtagtcccacagtaactgaagtgttagttggaaatattgagcattttatgatactaatgtattcaagtggataagaatggcatcttccttcttgtaattcagagcctaggtgtgtgtttggcaggggggagggggtaaaacaatatactgtgatgtatttccaggattccttactactatgttagtcaaagagctaaacatagacagatccattaaattattcaaattcatgtcttcaggttgtggttggtgacagacagggaaagaatatgggaacacagacaggtttgccagagcttttatttttacacaggctgaaaataaacctgagagtgaagagaaagagaagagagagggagagagagagagagagagaatatgagaatgaattaagagtaaatagtaggcacttatctaaattgacaaatatcttgcatttaactgattggctggatggttaaatttatactgtgaagacgttaagaaaataatcttttcactatcatttttctctctggatctattgatctgacttgataagtcattattccattaaattcgactgagaaactacattgaaggtacctaagacccaagaccacagcttaatatgttaactcttctttcagtagttcaaaaaatatctgcattccacagttgatatattacattactgggcttaatataggattgcattttgatactcaatccatatgctttgtggtaaggtcaaccctgaataacagttgaatcttaggtatgcaaatcatgtgaatgtgttgattgaattattgtgtaaaaagactacactaggatctgaatagtatttttgcaaattagacatataaattgcctacaagtctatgaaaagatgcttgacttcactaataatcaaggaaatgtaaatcaaagctacagtgaaataacacctcagccttgttgggatcgtcgttatcaaaaattcaaaagctaacaagtattggaaagaatgtggcaaaaagaaacccttgtacattgttagtgggaatgtaacttggtacagttattacagaaaataatatggagcttcataaaaattaaaatgaccatattatccagcaatttcacttcagggtatatatacagaggaaataaaattactattttgaagggatatttgcattcccgtatttattgtagaattattcacaatagccaaagtaaggaaagagcctgtgtccatcaatagaagaatggatatagaaaatgctgtatataaaaaacagaaagtacatatatatatatgtatatatatatgtatatttgtgtatgtgtgtgtgtgtgtgtgtgcgtgcgtgtataaaacagaaaattattcagccttaaaaaaagaaggaaatcctgccatttgtcacaaaacagatgaacctagaggacattttgacaagggaagtaggttagacacatgatatggtttggctgtgtccccacccaaatctcatcttgaaatgtagttcttttaatccccatgcatcatgggagggactaagtgaaagataattaaatcatgggggtggttactctcatgctgttataataatagtgagtgaattcccatgagaactgatggttttataagtgtcttttccccccttactcggcacttcttcctgccaccacataaagaaggatttgtttgcttccccttctgccatgattgtaagtttcctgagttctccccagacctgtggaactgtgagtcaattaaacctctttcctttataaattacccagtctcaggtatttcttcatagcaatgtgagaacagactaatacgataagtttatactgagggagtggggcactgctataaggatacccaaaaatgtggaagccactttggaactgggtaacaggcccaggctggaacagtttgaagggctcagaagaagacaagaaaatgtgggaaagtggaaacttcctagggacttggagagctcaaaagacaggaagatgtggggaattttggaacttcctagagacctgtgggatggctttgaccaaaatgctgacagtgatattgacaatgaagtccaggctgaagtggtctcacatggagatgaggaacttgttgggaaatggagtaaagttcatttttgctatgctttagcaaagtcactggtggctttttgcccctgacctggagatcatggaactttgaactagagagagatgatttagggtatctggtggaagaaacttctaagcagctaagcattcaagaggtgacagagcataaaagtttagaaaatgtgcagcctaatgatgcagtagaaaagaaaaagccattttctgaggagaaattcaagctggctgtatacatttgcataagtaatgagaagccaaatgctcatcattaaggtaatatgaaaaatgcctccaggtcatgtcagataccttcacagcagcccctcccatcataggcctggaggcctaggagggaaaattggtttcctgggctaggtccaggtctcccctgttgtgtgcagccttgggacttggtgccctgtgttccatctgctccagccatggctaaaagggcctaaggtacagttcaggacatcacttcagtgggtgcaagccccaaatcttggcagcttccatgtgatgttgggcctggtagtgtgcagaagataagaattgaggtttggggacctccatctagatttcagaggatgtatggaaatgcctggatgtttagacaaaagtctcttgcagggttggagccctcatggcaaacttctgctagagcagtgtggaagggaaatgtggggttggagcccccacacggagtcctcactggggcatgacctagtggagctatcagaagagggccattctgtccttcacaccccagaatggtatatgcagacagcttgcaccatgcacctggaaaagccatagacaatgctagtttgtgaaagcagccaggagtggggccataccctgcaaagccacagggacagagctgcccaaggtcatgggagcctacttcttgtatcagagtgacctggatgagagacatggagtcaaaggagatcattttggaactttaaagtttaatgatccctattaaagtttaaaatccctattggattttggatttgcatggggcctgtagcccctttggccaatttctcccatttgggatgggtgtatttacccaatgcctatacccttattgtatctaggaaacaactaacttgctttcaattttatagactcacaggctcaaaggcagaagggatttgccattactcagctgagactttggacttggactttttggttaaggctggaatgagctaagactttggagaactactggaaatgcatgattgtgttttgaaatatgaggacatgagatttgggaggggccatgagtagaatgatatggtttggctatgtccccacccaaatctcattttgaattttagttcccataatccccatatgtcatgggaaggacccagtgggaggtaaatgaatcaggatgggggggttacttccagctattcttgtgatagtgagttatcatgacatcttatcattttataaggggcttttccaccttaacttggtacttctccttcatgctgccatgtgaagaaggacacatttgattcctcttccaccatgattgtaagtttcccgaggcctccccagccccatggaactgtgagtcaatcaaacctctttcctttctaaattacccattttcgggtacttcttcacagcagcatgagaatgaactaatacaacactgaaagaaaaatattgtgtaatattacttatatgtgtaatctaaaaaagtcaaactgataggacagtaagtagaatcctgggtacaagtggttgagggtggggggaaaggagagacataggtcaaagtgaataaagtttcagatataggatgaattacttttggagactgaatgtagagcctggtgctatggttaataataatgtattttcttcttgaaatttgctaagagattagatattaaatgttctcaccacatacacaccacacaattgtaactgtgtgaggtggctgatacgttaattatcttgtgtttggtattcatttcaaaaggtatatgtatttctaaacataagcgtttacaacttaaatgtatacaatttttgtcaatcatacatcagtaaagctggagggggttaaaaaaacaacaatccccctcagttggctatttatattactaagtgaaaagtgctttaagaaaatattccaaaactgatattcttatgagattttagctataattaaaccaatgataggtaaagagatatcagtgttctctgttgaaggcttttacatatttaaaatctaaataggttatgcatgtcagtacactaatgaagactaacaaagacctcacatgagactgaaaaactgaactggagatgtagaataattgatgcagtgatggtattaaaagaggaaaggccattcaatgctgttaataagatgtgaaagtgtttaaacaactgtagaacaccagagcttctgcttgagttgaaacagtggctttaaaatggtatttagtaatccaggcatgatggttcaaacctataatcctagctactttggaggatgaagtgggaggattccttgagcccaggagttcgaggctgcaattagctgtgatcattaaaagcagggaaacactctacttttaaatgtctcccatgattgggtcagtcctaatctctgttattgtgaggctagctgaattaagacagtagttacatccacgaaatcccttctgcaacagcatttgagtgaataatgagagtaaggaaatcttggaggcagacaaatgttagaattctccctactacaatctctttatagtaactgaatagttgacatatgtgctaaaaatttttaaagcatgtggaatttatattacatgttttcatcaaatgttccctcaaatctgctctggaaaggtcccaaagttcttgccaggccctgtccatcattatgaaagctcccaattatataatatataatatataaatatataataattaaatactcagcccagcataatgtaatacgtaatttccaacttattccaaaattaagtcttttttctggataatgccactctaaacacaaagttaggagtggccaggagagtccagtttattttgcagcccataaaatcccctcccaacttgatagctgctgtttctgacacctccagcatcaggctaagggattaaaaaagggaaaaggaacagtcttacacgatatgaccttaatatcttccagatttaaccagttattcaaagctgctatttcctctcatgaagttttttggaaattacagattccccttcttaattctgctcaccttctattctgtttctgtttctgtacccatagagaaaaacaaaaggaccatactgagtgggcttactttgaattcgtgacctttgttctcatgtgggcttttttttttttttttttttttgagaaagagtctcgctctgtcgccccaggctggagtgcagtggcgcgatcttggctcactgcaagctccgcctcctgggttcactccattctcctgcctcagcctcccgagaagctgagactacaggcgcccgccaccacgcccggctaatttttgtattttttttttttagtagagatgaggtttcaccatgttagccaggatggtctctatctcctgacctcgtgatccgcccgcctcggcctcccaaagtgctgggattacaggcctgagccactgcgcccggccagctcttttttttttttcttttttttttttttttacacagagtcttgctctgtcgcccaggctagagtgcagtggtgcgatctccgctcactgcaagctccacctcccgggttcacgccattctcctgcctcagcctccctagcagctgggcctacaggcgcccgccaccacgcccagctaatttttagtatttttagtatcatgtgggctcttaatgctgctcagtaatcttatagtgtctttagtctctttgtcctcctagatgacattttaacattttatcctcacccctcaccttgacaacttttcctccttttccttttggagaatatggccattcatttttatattgcgggaaaaaaataggccgtcagagaagaatttctttggcttctcaccagcctacttctgtgcccctatgtaatgcctctctcctgccccatggaggaattctccacccttctttaaagacaccttctccacgtgtgttctagatcccagtgctcacacctcctcaaggagttctctacccactctctcttccatgcattgtcagtatttcattgattactatatactgaatcattctcgtcagcatacaagcatgtttttttttccttctattgtaaaaaaacatcctgatcttgttgatacttcttgtattagctagggttctccagagaacagaaccaataggatatatatatatagatatatatcatacatattatatatattataaatatatgtagggatttattaaaccacgccttaagcatttcaaatttatcatgagaaaaacatggcttagataattatataaacatatagatacttgttataaaatagtaagtaaaaaattgattaactcaaagtacatatataggaatgtaaatatgaaagatatatggctacaaaactttgcataagcaatcatgaaaatcaagtcaatatagaacctctagtgataaattgtgaagttcaatattgaaaagcttatggattttaaaatgcataatatcatcagttctgatttattaatagatgacataagtgacttagagagacaatgtgatagtaccaactcttcacaggagagcataagcagaagacagactagatttctagtcttggatcttcttactattacaccaccactgctgtttttaaaagaatggagcttatgcctctagcagcgttcataaagaagacactataatgaaataggagtcaaagaattagttttcaacaaaggtgccagaatacatattggggaaagaacactctcttcaataaatagtgctaggaaaactggatatttctatgcagaaatatatcttaccataagcaaaaattaactcaaaatggattgaagatttaaacttgagacccaaaactataaagaaaacaggggaagggcttgaggacattggtctagacaaacattagtaaaaccccaaagcacaggcaacaaaaacaaaaatagatgaaactatattaaacacaaagcttctgctctgctactttcacaatcaatggagtgaagagacaatccacaaaatgtggggaaatgtttgcaaactatttatctgacaagggattaatccagagtatataaggaactcaacaaactcaactcagaaggtcaaataatcccttgaaaactgggtgaaagatgtaaatagacattcctcaaaagacatacaaatggctaacaggtatttgaagaaaatgctcaatatcattaattattgggaaaattcaaatcaaaactgcaatgaaatactatcttcccgcagttaggaaagctattaccaaaaaaaaagaaaaaaaaaaaaaaaaacaaatgagacaaggatatggagaaaactgaatttttacatactgttgatttgaatgtaaaatagcagggcaataatggaaaacagtatggagatttctcaaaaaactaaaaatagaaatagcagatgatccagcaatcccgttagtgggtatttatccaaacgaaagaaaagtcaacatatcaaagggatacctgcacccctacatttattgcagcactattcacaatagccaagatgtggaatcaaactaagtgttcattcatagacaaatggatgaagaaaatgtgatatatatacacaatggaataaaattcagtcatgaaaaagaatgaaattctgtgatttgcagcagcatagatagaactggaggacattatgttaagtgaaataagctaggcacagaaagacaaatattacatgtccccatcatatatgaaaacttaaaaagttgactttatggaggttgaaagtagaaagtagaataagagttatcagaggctgggaaaagtggtggggaggacaaggaagggtaggttaatgggtaaaacatacagttagatagaagaaataagttctagtgttcagtagggtaaacactagcatagtacggtgactatagttaacaacaatatattgtatatttaaaaatagctagaaaagaagatttggaatgtttccaacacaaagaaatgataagcatttgagatgatggatatcttaaatactctgatttgatcattacacattgtatggatgtaacaaaatattatatctaccccataaatctataaaattattaggcaccaaataaaaaatcgaaagattttccatccatattattttgcaatagttagaattaatagatattatctgatttttataaaaattggggttaagattaaaatagcaatcacatgctatatttaagctttagcttttaaaacaaagtgttcatcaaaagacatgataggcagatttaagaattatttcagtaatgacttgaaattagtttgagcatattatatgaaaaacttttggcttcttcataaggtgtttaacgaaagaagaaaaattatagcatcagacattctaaaatgaaatgctgttactactgatattttaaaacatatcatctgcttcaggcaaaaatatttaattaaaaaaatcaaatgccttaatggaaacagctgcatttttcatgcatgtacaatgagcctttgaatttagatgaaataaatgaaaagtgacagcataacatccaaaggagaaaggaacacagatttggtattatgattcaaaataatttatttaaacaaaggggcagttaagtgaaattgatagtaaatttagtaaataaaaccaattgttttgttctactagtatttctgaatatggtactttcagagagaaaaaaagccctcattgctatttgactaaaaagtaatagacatactttttgtaacataaagttttgtctagtctctcacccaacagtttccataaaagtctctggtctttcaccaaagacttttttaaaaaaatttatttgttcctatgaagtgagaaaaaaaactaggcaagttacagggttcacctttcttgattttagtctagtattctcccttttatgaattctatgcggagcacaatttaataatttgtcctcaatggaaaattcaatataaaagtggctataatacatacatacaaggtttaaccaagatcggtattaagtaaacataaatatcacattttagaactagcagaaaatttcacattgttgtagtctaatagcctattttacatgagaaaaacaagaagatgagtttcctgacttctgaacagggattcatcctaccatattaggatgcaccagtatttggccatgttttatgaaccacatacagtgtcgatgaaatgataatattctcgattaattaacaaactctccataaggcttcatttatttccatcagttacagcactcatgactaacagtgagttatttttacacctatcaagttggcaaaaaatttttaataaaggaccagataataaatattttaggttttgtcgtccagatggtttgccatcactactcactctgcaaaagcagccatagacaataaacaaatgaatgagcatgcttttattccagcagcattttatttgcagaaacaagcgatgcaagatatatatactttttaagagtcagaatctcactctgtcacccaggctggagtgcaatagtgcaatcatagctcactgtagcctcgaacttctgggctcaggaaatctcctgcctcaactttctaagtagctaggactataggcatatgacaccaggcctggctaatttttttcttttttaaagactggatctcactatgttgctcaggctggtctcaaacttctggccttaagtgaccctcttgccttgaactcccaaagtgctggaattacaggcttgagccaccatgcccagccttgatgattcaagatagttttgcccatggtctataattagatgactcctgatatagatcaatgataactttatatgtatttcataaattgttactctgtgtatatcactatcatatcatttactaagctgtattgtaaatgtttgccctctcccccattcacacacagaagctaaagttgttaatgtaggagctctcattttttttttatgttccagaatgttggcagggtgaattttatctatcaaatattacagttcccaagaccaaatggaaatagcacagaaaacaagagctttcaaaagcttgttcagccagtttctgacttcaagagatgcttccacaaaagacagtttattaccaaataagtttggagctcttacatgatataaagtttgtttgaaagtcacaaaatgtattagcatagtgaaagacattataagtagctgtcacaaaaaaatagtttccaaaacttatttgaaaaaaagttttaaattcaatacctgctgtcatcttagcacatttcttctttctcttttattttattttacttttttgagaccaggtcttaatttgtcactcaggttgaagcacagtgatgtggactgggctcactgcagccttgacctcctggactcaagtgatcctcctgccttagcttcccaattagctggaactataggcatgtttcaccatgcctgcataatttttttttggatttctgggcttaagtgatccgtcctccagtctcagcctcccaaagtgctaggattacaggtacgagccaccacacccagctctcttttgccacagttactacgggactgagcgaaggaggacgaatgagaaatgaaaactgaaaacaaaagaaactgttttaaagaaggggtccagggaagaagagggctccctgcttctagtgagcaagggcagccacctgaacctcaacagccctttgtatttattgggtagaaagagcaaggagcaggaggtaactattggtcagctgcttaattgattacaggttcacattattgctaacaggcttcagatgtgcctaatcacaagaaacactacgcttggggcgtgactgccctcagcattccttctgggaggcagtcgcagtttgtcagtttgccaacattctgcatttatgagaacagtttgctttttactcatatagcctccagtggtatactgaattgatcatgaccctcactctttcggcctgcaacaccgtttctctactttcatatctccactcaccaatacttgtgctacactgtcagtatgctacacttggtatgccagcttaaatcttatttaagatgtcctttattcaatgaacatttttaaaagcatatgaaatgtcttttttaaaaacaaatttgtttttttagagtagttcataacaaaattgagtgaaagtacagggagttcctatatacccttgaccagcccacatacacagacagcctctccctctatcaacagtcccgactggagtgatacacttgtcacaattggtgaacctacattgactcatgattgtcactcaaagtccatagtttacattagggttcactcttgatgtcgcacattctagaggttttgacaaatatataatgacatgtatacaccattatattatcatgcagcatagttccactgcccccaaaatcctttgtgctcccaccagtaatatctttctccccctaagcccttggcaaacactgatctccatagtactactgtacatattatacatagtataaatactccacagtactattaattatacaaagtataaatactccacagtactattatacatagtataagtactccatagtagtagcatatgtattatacatagtataaatactgtctccatagtaattagccttttccagaatgtgatatagttgtaatcatagagtaggtagacttgtcagattggtttcttccatttagtgatggcatctgaggttcctccatgtctctttatgcagtaatagctcatttattttagggctgagtaacatcccattgtctgtgtgtaccacagtttttgtaacctttcacctactgaaggacatcttggttgcttctatgttttggcaattatgaacaaagcttctataaacatccttgtgccagtttttgtgtaaacattagttttcaacatatttggataaataccaaggagcgcaactagtgtattgtatggtaaaagtatgtttaattttctaagaaacgccaaactgtcttccaaattgcattcctgctagcaataaataagagcccctgttgctccacatccttgttagtatttggtattgtcataaaatgccttttagagttctgtttcttgaaaaagctaaaaaatgtaaataacacccacatttctttattttcgtttgtattgtgttcaaatatcatgattgtagatgattgcaaattgttgtgttgagtgttagaacaatgtctttgaattgaaccagcattttatgatctatcacttcctttacctgaaaatctgagattctaggttttgggactgactcttttctcattatatgactcctttgcccaccagacagcatgggttttatgatttttgttagagagatccccaaacatatgtggccaagttcaaaaataagccttccatcacagaagtagaaaaattggcaaaaagactattgataaaaagattgacaagaggatagaactcttgcaatgttaaaataaaatgagaagtaaatgagtttttaaaaactattcaccttggctgaatattttatttagtctttgggactgaagatatactgggtgtgactgagacaaaatattgtgaatggaacatcaggtgataaatgcttaatcttctaaccaaattctctatccagaacatttaatctatgtgttataagactattctttaatttctccttggtaccatgatcataagttgatacttaagaaataattaatatttctatagaacccactctcagtattccactaaaatataatatatctgaaatgaacatagcaatctcttaatatttctaaagtttaagtgcatcagacatattctgccacatgccaaacatgacacacagccggcatggaaaatactttacaacttgctgagccaattccaggagagttagaaaaattctggatattttttttttgaactaggtttagatgatttataatttcttaatgattctgtttactttctaacgttttattttaataaacaaagtttagagggagagagtagttccgcattaagagccagcatgaagaagtgcatatcattttttaaaattcaaacactctgcaagaacataggatatctcttaggctcccacctttggtttccacagcaatttttgggcttgtctctggaatattccctgtaagtgacaacattttcatgattttaatgtttaccaggtttgcactggaggaggagcaagggctggtgaatggaagagatgtttgggatacacaagactctcagtataaaagttaaaaagtagagcacatcctcatgttgcattcaccctttctggtctaacttcttgggtgttatgaatactgctgattttagaccagaatctttgaagcataagtagtgtttcctagaaattgctttaaagagaaaggatgggatgaaagaattagagcataggactgacagatgatatgaaagaaaataagacatagattatttatcaaatcaatccatgtgaagaagctttatgggtgggaaaggccaggaaatgatggcagaaatatagtataaattatgacagatattggtaataacacaaactttgaatttgatgagggagaaatatgattataaacataaagtatcataaagaaaatgttaggcaaatgtcatagactctcttcatcttgatcatttatttcaactcattattcaatccttaaaatttattttggtagacatataattattttttagtgtttctttttaatttaatcattagtttttgtattcgaatatgaccttttttctcattaagtggtatggaatgtagcaatacaatgaaaacttcttagaggccagaaaactagatagaaaatgattttaagttacactataaaatgttaattaagaataatatattttaccgttcaaggtggaatgaaaaccatttgagagaggaaagctagagattctagtcagaaagaacaactttatttttgcatctcttatactgagaagttgctaaatgtctcagaagtaaataaacaaagattaaggtcacactactaaggtgtggccagacaagtaagaatcaagaggtatcagtgattcttgggctgaaagtatgcgaagagaaaataatgaattacttattattggagtagttagcatttgtgttgaactacttcatttaaaggagatatccaaaatgtatataggcttttagtagcaaaaatgtaaaaagtttgccagctcatttttgaaagtatcttatttcatatttctacgcctctcaaaggttctttagacaatttggtttatcaattgttggttatatctggagtctactgataggttggcaagagaaaagtaacaatttctttataatgctcgtttgcccagataaatccttcctcagaaatatacgagtcagataaaaatgcaacatcatgataacagatgtaaggccaccacgtgattctgaggttccaacaccgttaggttccctggctgatggattctttacttctgaggggtatatacaaacaatgtaaaaatctgttatttccacatgaggttattggtgaattggacccattctttctttccctaaagagtcatatttattcaagtgggttctgcaagacactgacttttcttgcagtttctcctgcaatgtccacagagtttcatgtagattatggactatggtgataatcggaagaaagattgtattctctctctagaaatatgcatatataagcagacattaaaaatcaattatacaatttccccaggttcatgggctcccccaaatcttatccttggaatctggtttaattaaatagtcttatagtggatgggtcagaatatgattccttggtgaatcctccggaggctgccacataaagtgacagcagtgaacactgttgatgctttatccagatctcctgtttctatttaacactctgtgctttcctccttcagccctgtggtgcttttcatatccaatacggttctttcttagaggactatcctcagctgctggagccattttactttctcctaaagtacctgggggtacacttagctggtgactagggtacgcagtccctgtgaaatccagctccgctgcctcactttgggataatctctgttgtgtattttctattccggcatcccttgagcgactaagtaaaagccatcttcagtaaaactgcatggacttgtactctccttgacttctcctttcctttcctgctctactcttcttcctttacccgtttactctgggagcatttcattaataaatcacttagcatacaaaacattctctcagggttcgctctttacctaaaactaaccatataatttaatcatccaaactaggtacaatattggagagcaaatgggatgctattatcaattatactgtcataagtggtataaatggcaatgatgtagaacaaatcaggatacgtggttgtaccaaggctacgtggctttttacaaagatagctcttgtgaactcttttattcaaagcccttctaagacatggcacatcactgagttgctctcattaaactctccttaacatcttgatgttcctagtatgttaccaacatgagtctctattagctcatggttaactgatatccttttccagactatctcctcaccccacctgctactccaagactcctctcttctcatcctacccttatcttccatactgggttgtaacgtgaagtctgtcttttgtcttggaaatatccttacttcagtatattctggaacttaacaacaacaaattcctcttcacatattcttccagagagctcaaaagcagaatgcaaattgagttctagcaatagcccacaatattccatatttcccaaaggaatctaggcaaattgacctctgtaagtggccattattacatgtgatttttggatctgttctgccctagttttgactaaacttttaatttgcatactgaatttaaggaagatacaattatgagattcgattgagcttctgatgtttgagaattttaaaattatttacagaattattgtgagctattaaaatcttatcctagtggacaatgtacactctctttggttttagttaaattctagaagtgtaatatgtgagtcttctattgacaaaacaaaaagccctttcattaaaaataatattgtattgcaataaaccctatttttttagattaagaattcttgtctcaaaatgtttaccttctcttatgatatactagccacattttacaaatatagttggcccttgaaggccacaggtttgaactgctcaggtgtacatatacacagacttttttcaaccaaacacatattttaaatacggtattcatacaatgagaaaccagcatttacaaggagccttttctcatatgcagtttccatagggctgactgggacttgaatatgtggggattttggtataagcaggagtcatggatccaatctcttacatataccgagaatgactatataaactatataaacaatcatctcttagctataggtctgaatggacctaattcagttttagaattatccagttgactatgcagccataaaaaagcactagatcatgtcttttgcgggaacatgggtggagctggaggctattatccttagcaagctaatgcaggaacagaaaaccaaatactgcatgttctcactgaggagtgggagctaaataataagaacgtaaaacacaaagaaggaaacaacagacctcccggggtctacttcagtggggagggtgggaggaaggagaggagcagaaaagacaactattggcttattacctgggtgatgaaataatatatacaacaaactcttgtgacatgtgtttacctgtacaacaaaactttacatgtacctcctaacctaaaataaaagttaaaaaaattatccagttgattccaaaaaccagaatgtaactgaattcattgtaggtatgaagatacttaaacctagtcaatataagcaattcatagaggctaaaatggattgaaatgtagacttttgtcagtataggataaaaattacctccacagcaaatagaactcaatcaaatcagaatcataatccagttttaaaatagacagatttaagtaataagttgtttgatgatacaatgattaggatactgtttgatttcaaagaagcactgcaatgaagttttgtaatacaggttggaatctcataatcaagccagtgatctcttgttctttctcagcccaaagtaaataccatttatgaattggatatctttccaaaacaaagatataattaaactcaggaggtagagaatataaaataaaataaattgagtgtgtaaaataattaaattttgtctaagagccaattaggcatggaatattggcaattcttgtaatttcaatgtaatgttaccatttggcataataaagccattaattcaaatataaaaataaatatcaattatgaaaatgtacatttttactaccagagaattttaagcacattaattatactttaaaaattatcttaagtcttcacagtatttacacagggttagctgttgtattagggttctcttagagggccagaactaataggataggattataggatataggatatttatatatatatggggctttattaagtattaacaatcacaaggtcccatagtaggctgtctgtaagctgaggagcaagaagagccagtctgagtctcaaaactgaagaacttggagtccaatgttcgagggcaggaagcatccagcactggagaaagctgtaggctgggagactaggcttatctctccttttcacgtgtttctgcctgctttatattcactggaacctgattagattgtgcccaccagattaaggatgagtctgccttccccagcccactgactcaaatgttaatctcttttggcaacacccacacagacatacccaggattaatactttgtatccctcaatccaatcaagttgacagtcagtattaaccattacagctgtgtgacaatcttattcctaaaaagtttaaaaagaaactattttactttatctgatacttataccaaaatgcctcttagaggataggatacttaatacattaagaattactagtacattgaattagcaaggaatgaattttccttaccattattattgttattatcccaagtataagtcaggatttttggagttgtttacgtatgacagtgagcatagcctcattttccataatgacatgtggcctatatatatacatatatatgagaagagatatatagttatatcttttaatcttttaaactaatatgtatatatctatatatatctatatataacctacatgagaaaaaaacctgcatgattgaaagagatttatctctaagaatactgatctcacgccataggtttagcctttgcacaagaaaacaaatagaagagaaaatattgttatatgtcttttgttttcccaaatcatctaacaataaatatgaacaacaggatcatctgtttgtagccaatttatgttgttttcatatttaagggagatatgagggataatggcaaaatcgttaagaggatgcatataaattacacagtttgctaatgttcaaaattttaaagtttattattgtcttattaggtatggaattggtctttgttttagaagagcccttgccaataatttagctaaaacttgggctcttatcatatcataaagcattcttccaaccttcttctgccctattgtttccttctgtcatcagtcagccataatgataatttcttaagagccaaatcacaaaagcataaagcaataacagattaaggtgtcgtgcctcttctcagtcattgtgacactcactctctcagctgactccacagaatattcatttgcccttcttccacttatgttgtacttactggattagggaaataattaattttagaagtcatatttctataatttcccatatgtcaaattttaattattataccgtatggattgagatcttaactgtgtcaacaatgataaatatgttagcctaatttgtataactcattttgattttaaagtgagtgtgatacacatagtgaagtgtttctcaataatatcaaatctgaatagcagaaaatatcttctttgcatttgaactgttccagctctaatcctatttcatgactctgtgtttttgttaaaaaagatggaattgacactcaatcaccgtgattattttgaacttattgaaaaagaccaacaataaaatcatcatttttctgtagatacagatgcacatctgtggactcaccactctttgattaattcagttttttttttaaaagtagaatttaaaagcagacagtaaagtttcctattaatggtgatagagcattatgaaatatttgtgtagttgttattttttatgtttgggggcttttatgtctttatttcccatatgaattttttattacactaatagcatattaatggatattataaaacacacctgcaatatttttaatgctttatgataaatttgaaataaattatagtagattgtaatagtcatacattgggagagggaaacattaatttttttcagatattatcaattacctgaatgaaatagcagcaatcagtggaacatggttttaaacagtatcagtcaatagtcaacatacactttgtgtatcatactaactttaaaaataacattggtagaaggaagattagctaaaacttacaaggaatctaatgcaattttgcaagttgcctcaccttgcttttcttagagaacaagaactagtgatctaaggaacaaattatttcactcagaaagcatttatatcacagaattttagagctagatgagctcttggcattcattatttatggaaaattcctagtcatcctttaaaactttaggaatgtttacactttgctcagtctttcctaccacctaggatcaagataaatattcttttttttctgttctttcttgagttacttcacatataaacttaatgattattttatcatgtgactatctttatgaatcttatttgtatttatattaccaactttaaatacaggaactgacagaatgtatttgcttaacatatgtctaagaaatggataaatgaattaatgaagaattattgaaatgacttgctagtgatacttgtggcaatactttgacgtaagttttatgctcatgcaattcagcttctaatatcctcctgggtaaacctttaagattttatatcctttggctgcaaacaaatgatacatacattgcacaaatcagtctaattaaccacggatatattgttgtctcttcaactaacatgcataaatcccattgtggattttataggaaatatatctatgtagttcttcatgaatgaagctatgaaaagaattatttaaattgtgtatattgatagatttgcaattgtactcatgttactggaatcacagtgatgatgaattttaatttattcttttaaagaacataataaaaattagcctaaattatttttgatgttctatgttatttaatttttatctggtattcattaactctacataaaaattgacatacaaaaaatccagtaatgatctagtgattgttttaaactgggttttaactccaggaattggagtgagctaacagaacgtaggagaaagaagcaatacatcttggacttctaagtggtcttgttacttctaatttgacttccttctgatccatgagccatactccggtgtttgtgaactactattctttgccaggcactgttctaagagctttatatgtatttaggcctcataaacccaagagataagtatattcctctctgtcttgtgcagcatatagaaactgagatagaaaggttgctgaaggtcacacaaccaaaaaatgagggagttgattctaagccagacactcttaatggaggtgcaatgcccttgtccactatagggtagatactatagccttgtactgcttttatactgtgaactgctttgaccctcaaactgtgggttattaacctctgaaaacagcacacacttacgtaaagcaagtggtttagagccatctatttcaatatttgttcattgctatctttttggtcaacaaaattattttcatgttttatacttaaatgataaaatttaaatgaatttcctgtcaattttattttaaaactttatttaaagcttaccatgtttttacttttctctcctttgactgagctcagctatacattcatttctgctttctcccccaaagacatgccttgaggttttgtgaatatgatgttaataagtaattaattttgtgtacctggagaataacatgttcacacagcaggtgtgacattattttgaaaaatgttctgctaaacagagccgaagagaaatgaatttgcatatagcttaagtctggctttgttttttttttttatcttaaagtgatatttcattcatctgttggattaatgcaaaaaatgcaataaaactctcatacatatgagtcatccactaagtaattcttcaccatgtgatggtttatcatagaagcctgatacattgtaatttttaaaatttaacctgggtaccaacctgagtccatgtacctttccacagggagactgaagctaaaagtctttgaattcttactaatattggtcagacatagttttaattttatatcttcacagatagcagacagaatgacactaaaatgaccctgagaaatattaaacacaccccaaaccctgttcgtccatcaggttgtcaaagttatcctataatatctaaatgttcaataatgtgaactttttctgatatagtttggctctgtgttcccacccaaatctcatttggtagtgtaatcctcataatccccatgtgtcaagggcaggaccaggtggaggtaattggatcatgggggcagtttcccccatgcttttcttgcgataatgagtgagtctcatgagatctgatggttttataaagggctggcatttcccccgcttgcacttctccttgctgccaccttgtgaagaaggtgccatgattcctcttcaccttccaccatgattgtaagtttcctgaggcctccccagccatggtaaactgctagtcaattaaacctctttcctttataaattacctagtcttgggcagttctttatagcagtatggaaatggactaacagatataatgctgttaaagagactacaggctcaggaagaagaataattaatagatcaataaaccttggttctctctctctctcttcttccctccctccatccccctctctctttcttcctttcttttcttcttttcttttctctttctttttcctccctcccttgtttctttctttcctttctttcttttccctttctttcttccttccttccttccctccctccctccctccctccctccctccctctctctctctctctctctctctctttctttctttctttctttctttctttctttctttctccattaggcatttcttcccttcatccttctatttgtccaaacatctttcaacaaagatttttgagcaccaattattttccaggtattgcattatttacttggtatttataattaaataacattgacaagggttcctgctctcctggaaattgcattgacatcattctcagaacaaaatttccctagctagatgtgttatgggtatcagagcagaatgaaaatggaataatacgtaggcttcgaaacagaagtgtgcccataatgaatagtggacataaatattatgtgattagcagtttttatcagtgaggctgctgacctttgcatcaacatcacagtgttttaccattgttgtttatgatcaaaactgaatttagactgaaattctgaaagctgagtccagataaaatggctcagattcagaaactcatctacagtttgcaaggctcaccaaaggactgaccatttataacattaaaagacctcatatttccacctatgttgagatagatgaatgtttctttgccagttgttaatttatgtgattttctgatttgccttttattgaaacatatttggtcctgtcatggatagcttctagtgattttaaatgaggagtgagaggtaaaaccttcttaggcagagtcctgaataatatctgaaatagctgaaagacctgcagttgtgctctgatctttccgttgtttgagctcctacatcaactgcttgagtggcttgattcttactgctaagaagcaaaaccactcatttacatatcaacaggaactttctaagtggcaggttgttagaattttgtggtgtggaagaagcagtgttgatgagtcatcaacagttgtttgctatatttaaattatccactgtttaattattagtatactgtaatgacaagctttctttagtgccctggaaataaaaatgaagcctattactaaattccacactaagcactatgtattttttccagacaaaatgcaattagcacaacactgtttaataatgcagttttaaaataatgcagtatgtaataatagtagcccactgctattaagtgactatctaatataacaaagcaggaaacatacaaggcaaaaactactccaaatgtttttaggagttgattagaattcagtattacctaatacctcataacaatatgaagtaatagatttttcttaggaaaataattctgaattttctgaaaaaaatactatattctgggtaaactgtgatattattcaggcagcatgaatttctgtgtggtttattaaatttacatgttcttagttttttgtagaggtacgtacaaaactgttttataaaaaacagaattttaaagtaactctacctgggacaggattgaatgtataggtggctttttgtttgagccatttcagtgcaatatttcctcctgctaagaaaaataaagtaaaataatttggatctgctgaaaaatatgctttgaagattcaaaatactttatagcttgaaacccatagggcaagtaagatgattagtagctttagtaacgacatttgaaattaatactaatatatgcatctgaaatgctatttttttctgttatatttaacattcatttcagcatttattgatcttccgctatgttgaagacactgcgtcaagaaacttgggagacacaaagtaaaaggagaataaacaacgaacatgctctgaaagcaagcttaatatttggcaggtagtaggatgggtgataaaatttcactatgattcaaggcagaatatagtaaatgcttcaccagaagtatacacggaagacagggagaatccaaaggaaagaataattaaaacatctaatgggtgtgtttctctgggacgtaaaggaaaagcaaattcttatgggtgaataattagcaaaatatattgtctattgtagactgaaggaatagcataggaaaatgaatatactgcttaggaaaaaaataatctccaagaattggggtataatgaattggatgttgtggctgtacgcatggagaaagatgtagagcaagttggaatgtggaaattcttgaatgccatgtgtcttacccataccctagaaaacagaacctggggcaaagcttacatgctctagtgttattggatatttcactcctaggaaatttagagcatgggaaagtgcaagtgaggcaggcaagatggaaataaaatgtaagatattgcattactgagttgtcacctgttttacaagaaatcacagctggatgtttggtcaagcaggacatctccaaagaggccatatggaacaactgcatctcaatgcagtctgtcacagggtagaaggtgaacaatttttctcctgtctgcttcccattttctatctcccatagatcaaaattcaacccataagtgatgatagtgtcctaaaattagatagtggtgatttttgcacaactctgaatatatgaaaaaccactgaattgtacacatcaaaatggtgaattttatagcatgtggctcatatcttaattaattataaaaaaatcaatccatcacaagctagaacgtttttggggcccaattaaattggacttaggaattacagcttctgtaggttctgtatgaaacatagcaactcagataagctcaagtcctgttcccacctttatgaacaactgagacagttatcagtgtgagaagatggagtgaagattactgtggttatagcactgttacttaagaaatgatttgatcctccactcagattaggaaacaaagttattggacaaagcccagaaaaatagttaaaactaaaaatatctgggaagatgcataaaccagatccaatatagcttcgttgtaatttattctgatcagttgcaccctctaatatgagaataagatgcctttactttcaaaatggtttattgtaatcacctaaaaaaggcttagaaaaaattaagaaatcaaactgcagtttccatcgctgcatcagatcttgagctctgagattaaagattgtcacagatcctttgctcctctgctcctccttccattaagaggtggaatccaattaccctcctgttgaatatgggctggtcttagtgattttcttgactagcataatgaaaaagaactgactttctggtacttggttctaggagcaataaagacttgcagcttccatcctaatcttagaacactccctcccaaaatgataagaacacatggacaccaaaaggagaacaacagacactggttttggcaaggaagctccagatgtccaatagagaagaactgaagtgcatgggtgaaaggttctgagcttccagcagacagccagcaccaactttcttccagccaacaactagcaataacttgcaagcactgtgagtgagctatcctgtatcgagcttctccagatgatgatgctgtgaggaagagatgcaacctgcccaggcaagcccttcctgaattcctggcgcacaaaatgatgagacataataacataaattttatttttatttatttttttaaacttctattttaggttcaagtgtacatgtgcaggtttgttatttagggtagattcgtgtcatgggaatttgttgaacagattattttgtcacccaggtactaagcctagtgtccaatagttaattgtttttttttttttttttttttttgagtcggagtctcgctctgttgcccaggctggagtgcagtggtgtgatctcggctcactgcaagctctgcctcctgggttcacgcagttctcctgcctcagcctcctgagtagctgggactacaggcgcccgccaccatgcccggctaatttttctgtatttttagtagagacggtgtttcactgtgttagccaggatggtctcgatctcctgacctcatgatctacctgtctcagcctcccaaagtgctgggattacaggcatgagccaccgcgccctgcccctagtgtccattagttatttttttctgattctctccctcttcccaccctcaagtagaaaccagtgtctgtcgttctgctttttgtgcccatgtgttctcatcatttagctcacttataagtgagaacatgtgtttttaagtcacagagttttggaggtcatttgtggtgctgtagtagaaaactataattgatattcacaatctctctcttaagccacccattctagattttcctcaccaccatttggctggcttgagttattctcctgatagcataactcagattttcttccccaaggtacctaagattttagtctccttgatttggaaccatattttctctacttgttttcatcatgattacttggtatggatacattggaagcaacccagggatcacctgggtttaagaaatacttctcctttctcccatggtttaatggcaaacctagattctcatgattattttatcattataccaatgttttcctttgcccactggtaggctggcatgaagtgcacaggtggctatgtgttttctgcagcttctactttagtagaaacttttctgtgtttcctgacataagtgtttacccgtgggaattaggcctccagattgagagggtaaaaggttttaagaatacaaagaaactcatcaagtagatcactggcagtgatagtaagaggaatgaatcttatttctaccttttacgtcgtggacccatgggttcaagctgttgggacacagccctaaatcctagccattgataaagtgcatatactgcaccccagtagacagtatctcaagcctcaaagtattgtccctgagcttgcactctagatgaaccttcaacaggtcattcaactatattgtcagctgcctatttctggataatgaagtccattgccagaatgatgaatcctgtgtcatttatctcctgtgtcataaaatgtgcctcccagtcctagaaaatattacgtgggatattatatcaatgaatgactagtctataagctcttggatactggtactatcagagtctttgcaaacatggaaagtaaaccaatatttacagcagagaatgattctagaaaaaacaaattaattcccactgcaaagtgaaatatatttaaaaaactcaaacattgtagcagttccctaatttttggagttttataccacaacatctgtcatacatgtgtctaactagagcatctagcctattcgtcaagtcctgcattatgccattaatgtaaaatcatcaatgttgtagaacagggcaatttttcattggagtgtcaaggtggccaaagttcctgatgagtatattatgacaaagattatcaaagttagtatagtttcaagggaagacacagattttgatcctctctactattgaagataaaaaaaaactttctaaaatataaccatatataatgtgccacagtctatgttgatatgctcctgtaaaaatatcacatatgatgtgacattttcaatatgggctacaacctgattaagttgactataatcaaccttcgttgcccaaaattgttctgtttttttttcagaggcaacaagatgaattgaatagggatatggtggagtttaccatatcctcaatactcaagtccttgatggtgacttagattaccattcctcccaaggaatggcttttaatttgctatcttggccaaggttgtggggtgaggtcttccccattgccgttcctataaaatggctgttacactacagattgtgaaaccaacatgaacctttctgttaccttaaaagtatattattccagttataaagttggatcctggattaataaccagagcataggtctattaattacctgtttgccatgagtgtctacaatgaactgaagtccatgatgataaattttaagggcgacataaattccttaaattgtctttggtactttttttaagttatcttggaaaactgcctcaattccctttgaaatatctctccctcctcagcccacatctatctattcatcgtatctctcaaaatcaacagaccctccccttttgagatatatgctgtgcttctctgggttaccacagcatttggatccacctccacacacattgccttggcttctgctggtacatattaatcagtttctataattcccttgataagggtgtgatttattctttcagcagagattatacttctctcctcaggctatgcccaggcctgctatggttatcagcctggtagaaatgaagtagtggaaattgaagaaaacgaacaagattagaagaacggattcttttgcaacaagggttaaagtgttgctgcttttggccaggagggttaaaagagacatggaggataaaatattcagtttttccatcccatagaccttagggccacaccctttcactcacagagcacttgtttgatgatcagagacctcaattattgaaaataattttcctttaaagtactacactccttataaccaggtaaatttttagtacagtgtttcctgggactgtaagaggacagtcttcattaaagctcccattgaaactctgtggtttcatagtctgatgtatgttagcaaatgtttccttgagctcatcatttttttttttcaagacttcccatgctgtttaatgcaaccaccagacatcaaatacattataattattactgcattgtactgatcagagtagcaccacttgatctttccattttgtacattttacctgcacacttttctaatttaatcataaatgaaagctttaataattgtgattccactaaatttcaaaaattgttaccaccttgcttgtcaccagcaatatggttcctattgcttccaaacaggcagacaatgaatgtagatgatggcttacttcctagagtccctctgacattaattgtcatggcctagatttcctggaaaacagaagctaaagtaaatgttccattcatggaatcaaaaatgagaagaaaggaagcaaaacaggaatacaggaaaatcaaataaaggtgatgcattattgaactggtcgcagcttctatgtaatagttacctagtggttgggtcataaatgatatatctggagagaccaaatatattcactgcattttgaaatagtatatttaaattaaaaagtcttgaaaactccatcaagggaagaaagggaaagcagtttatttgatagctgttttctacctcttgctggttaaaatttgttccataggatgctagtttcacacttttgtattctattacacacatcttataggatgccagggaagtttgggtcttatgacactaattgagtcacacctgggccttagagctcctgtggcttacactgaagtgagtatgtatacgtcctgcaaaattctagccttgctcttgtagaggtgtgagacaattagaggttatgggaaatgaggtgatagtggtggcattttgggcttggagactatatgtctaaaaaatgcatatcatcattagtacacattcataatccacagcgtaaggcaactgtataaaatatatttgaatatctccacctgaggtatattaggacacagttcttttctatgtccaaccatcacaatttttccaggattatgttgactataggtaagacatgactggatatatcctctgatattaagaagagttatcaatcaccgtttgattaatgtggaaaattcattccttttatggtgggttatctcatggaaacataatttttcaggtattcatttgagtttattttgtgtcaccattcagccttccttgctttgttatggcttattatacaatacattcttagtatttcacttcaggatcagtggtcaaattttatgcatctataaatggaaatttttaccttcatggatttttctttttgttatataagaagtctttgcacagaatattagtcagcaaaactggcttagcatagtgacctgtgtaagcatttcctgtacatacatttattatgtcttttatggtggtctctacctttataatcacaattttatcaggtagcatcgaatcatcaagcgatgaatatatttattgtccaatttttgtaggagtacttgaagaggataagaatcatctatgtttccttagaattttaaggctgtgagctataaaaatctatcagctatctgtgattatgtttatccttttacattaatcaaattgacataccctgcaaagggctgtaagtttagccactggagctgatttattttggtaagaaactggattctacgcatgaatatggagtaattattcatcaccagcctggtatgttgcaggaagtcagggacctcaaacagagggaccggctgaagccatggcagaagaacgtggattgtgaagattttatggacatttattagttccttaaattaatacttttataatttcttatgcctgtctttactgcaatctctaatgtaagttgtgaagatttcatggacacttatcacttccttaatcaatacctttgtgatttcctatgcctgtctttactttaatctcttaatcctgtcagccaaggaggatgtatgttgcctcaggaccatgtgataattgcgttaactgcacaaattgtacagtatgtgtgtttgagcaatatgaaatctgagcaccttgaaaaaagaacaggataacagcagttgttcagggaataagagagataaccttaaactctgagcgccggtgagccaggtggaacagagccatatttctcttctttcaaaagcaaatgggagaaatatcgctgaattctttttctcagcatggaacatccctgagaaacagaatgtgtgcctgcgggtaggtctctaaactggcccccctggacgtagccgtctcttatggccaaggctgcagagatgaaatagactccagtctcctatagcactcccaggcttattaggaagaggaaattcccacctaataaattttggtcagaccagttgatctcaaaactctgtctcctgataaaatgttatcaatgacaatggtgcccgaaacttcattaggaattttaatttcgcctcggtcctgtgttcctgtgatcttgccctgcctccgcttgccttgcgatattctattaccctgttaagtacttgatgtctgccacccccacctattcgcacactccctccccttttgaaagtccctaataaaacttgctggtttttgtggcttgtggggcatcacagaacctaccgacatgtgacgtctccctcggacgcccagctttaacatttctctcttttgtactctgtccctttatttctcaagccggccgacgcttaaggaaaatagaaaagaacctacgtgaatatcggggcagattccccgatactggtgttttaccttttcatttgtgagataagacacatcaacacacaatgttccataaggatttggtataggaacgtctaaataatatgctatgaaaatgggcaattatcaaactacagaagcataatcatattctccatcagataaggatattaaacttgctaattgagagtatagatgcacatttaatatgaggaaagaatatatatttttcatacttaatcagctagagcatgacctaaccattcatgtacatacaagaagaaaggcctatagtaatttggtagacccacataggtgggtgttgaaggaatattttgagattatttaaaggattttctatttctgtaacctatgggagtggttctaagatgtttgatttagttgctataaaaggacatttctttattttagaaaaatgttggtgcccattatctagattatctgtttgatgcaataaattcctttgtcctttagttattggtcatgagtaatttgggataatttgtaatctgctcttggataatgccttcagctggtgggtcatagcctagaataatgaattgttttgcagtgttgaattttgttttttcttagaagcttgatatccctttttaaacagcttgatgagtttagaaagagggtcaattttaggattttccaaattaagagaatgtaatagggtgttatctttttattagatcagagtgagtccaccggggctctgtatactgtaaagatattatttcaatatttggaagaagtaaaacatatcttcagtgaattctttggtatgcaactttctaggagaattgttgattttccctggaggatgcaaataaacattgactatgttttatcaatttggagactaaattaacaaatatatctgagcatagatatattaccataaagaatttggctatagatggaactgagaagaatatgagtaaggtactactcagaagcaaggagttacaaggagttcgtattttgtgaatttctcattgaagttcaaaacaatataaatcctccaccaatcatattgctggggctgactaaatgaatgatgagtccactgtccatagatacagttggtccaaaaacttccttgacatcagcttaacagggtattgtaaaactttagacaaaaattttgaagactaatctgggcacacaggggtttactctaattattttgcttgtccgtatagattctttgcccacatgtttctggaaacaactacgtttttaggtgtttcttgaattacatatagtgtagctacgtaaatgtatatatcagctatcatttgatggtgggtagaattttctaggactgaagaacactttatctggaaataacattttcaaaataattccctatctattgaatttgcaggagtcatggcatagaggagtcatgctggcatcatgggcatgtgacctgtgcagtgccacagggccccatggttacaaggatctcatgcttgctttaatgccctgctgtaatcatcttaaaattcctattaattattgaacagaggccccacattttcattttgtactgtgtcccacaaattatgtaactcgccttgcagaagactggtaccagagttcatagttacaggttagtcatagacaagaatttaggattcttagaaatccccagtttaagtggtttgagtactctgggggatttggtttgctgtatagtaatggagttgattgtacagtggtacccatatcaataagaaagctatattattatctatttatattataagtaattcccaatggagctttaaaacgagatagaaaattgctggtgcttatgtttctgttggatcaactgtctttggacagttttttttttttttaatcagtgtgaggcattgatgttccaatgatcttttcttccaatatctacaagaatccttacttataagctttatgttcttagatagtagaaaatcctttcttactgtgtttgtttgtttgtgtgtttgtctcatctggagagctggagtatatatatagagtggaatgattgccacaatcaaagtagctaatacattcgtcacctcacataattaccattgttttccttttgtggtgtgaacacttaagatctactctcttacaaaatttcaaatatcaaatatagcataattaatgatagacactatgttgtaccttagatccccagaactttttaatcttacaattgaaagtttgtagtctttaccaacatctacccaaaccttgccccttccaaaccttacccctggaaaccatcattctagtatgtgcctttatgagcttgactttttactattacacatacaagtgagaacaaacagtatttttctctctgtgtctggcatatttcacttagcataccgttctctagtgttattaatattgccacaaatgacagaatttccttccttttatggctaaatactattccattgtatgtatagacaacattttctttataaaatcattcattgattcacaatttggttgttttcatattttgactattgtgaagaatgttgcaataatcatgaggttgcaaatatctttttgaaaaacttatttcatttccttcatttatatatccagaagtggaattgctgtttcatacgggtagtttcatttttactttttctgaggatcctccacaccgttttttatgatggctctaccaatttacattcccatcaacagtgtaaaagggttccctattctctacatcttcaccagtacttattgtctctttgctttttgataagaaccttcctaacaggtatgaggtgatatttcattgtattcttgatttgcatttccctgatgattagtgatgttgaacactttcagatagctggcagttgtttgtatatcttctttggaaaaatgcctattcagaatctttgcccattatttaatagggttgtttatctatttttgctattgacctgtagaagattattacctaatttggatatcaactctttatcagatagtttgaaaatattttctcccattttgtaggttgccttcttatttttagttgtattatatctttcagttccagaatctctgtttgattcttttttttatggtttctattttttcattaaacttctcattgtcttcatgcagttttcctgattttgtttagttgtatatctgtgttctcttgtatcttgttgaactcaagataatttttttaaaattgtttgttaggtaatttatagatttctgcttctttggggtagtttattgacactttattgatttcctatggtgatgttgtgttagtctgactctctatgatttgtgtggcattgagtttgtgtctgtgtattaaggggcaaaacactttttctaatctttacagatgggtttcagcaggcaaaaaccttctcctgtcaatttcttgggctaatgagattccctttgggatccaggttgagtggggttggagccaggtcacatggctgctactagatctgaggttgacagccctatggctaggagttcaggtgggtatagctcttgcttaatctttgaataggcaagactacattcagaaccttggtcagtagagctggtactgaaacaagtttcaaggtctgcagttagttctgcacgtggtagacctgttaccagattcatgtgtagttttggctcctgcaggttccctgagaatattccccctaggtcactgggtgtatttctgggtgtttatggctgctcctgaccacagctgagggagaatggagctgggtcatgggccacttcaggatccactcccagaaccaagttggtgggcctgttacttgaggcatgggaaggtgtggctccatttgggtgtcctggagtatggcgctggtggcaggaccaaggccaattggagctgtaactgaatccacaggggtatggggctgtttctgggttcctagtcaagaccatgatcaatgagcctgtcatcaggttgcaggcctgatctctcaatatagctctctttggtcttcagattcatgaggatttcacaacatgctacttggatttcattgctctacaaaaaagtatttttgtctggataactaccaaattattactgctggaagggaatgtgagtggaggacctacggttctgccattttactgttctcactccccaccaaatctactgtgaagaaaaaggggtttctaacggtcttatataatgtatttcctacttgttcttggcttttcaaggccaaatttttgacatatgtgtattgggttttttagatttcctcctgatgttttctattatgctgctttcaacttgtaattaagaaaaaaagttgataaaaatttagtactccaagacgttaattatctaagaaaacactgaattgcacagcagattttacctattttttgaggcttagggaaattcttaattatagttcttaagaactctagactaaggtttaagtacaacttctatagacctgccttctagtccagcaatgggatttttaaaatgcaattgtttatttcctgagaaataccatgaggaaaatgtttcttatttatgaggtcaggggaaagagcagaaggaatataagtggtataatttatgaggaaattaagtctgagagtaaaagaggtacaagagggggaggcttcagagatttggaaggagtttgattgttttttccttggacttttctacaaagtctttgagggtttctatcttggagtcaatattttgattttaggacttcatataagaaagtcaatcacagattacttggtatttgtctcaggtctttttttttttcagagctcctcgtaaatgtattattcttgatatgtcagaagtttcccatattggccattgtaattcttattaaatcttcctatttatcaagataagcataattatttgagttagagtaagacaaaatataggaagcagacgttctgccagaggaaagtcagctttaatgtagagatgaacttgagattaacaaaaaagtgcactaaaaacagtaaactctctgtatttgtgaatagtgtcttggccttccccaatcaagcaaaggtatgccaacaatgcctcaataatttgtttaatttgtttcagctttattgaggtataatgatatacaaaaattttcatgcatttaatgtatacattttgataaatttagatacctgtgtatacccatggtaccatcacaacacccaagatactaaacatattcatcacctccaaaagttttcttgtgttttttatttagtggtgtgtaggttttgtttgtctttgtttgtttgataagagcatgaggtctttcctttaacttattttaatgtatataacactgtattgttaaccctaggtactatgttatgcagcaagtctctagaatgtatttttattgtaaaactgaaacttcgtacccactgggcaacaattttccattttccccaaccttatcccccggaaatcagcattctactctgtgtatctatgaatttcactcttttagacaccccatacaagtgaaataatgcaagatttgtctatctgttactgggttgtttcacttagcatagtgttctctaggtatgtctatgttgcaaatggcaggatgtccttcttattttaagaatgaataatattccattgtatgtatttaccacactttctttatctaactgttaataaacatttcatttttttccatatcttggctattgtgaataatattgcagaacctgggagtaaaaatatctctgtgagactgatttcaatttttttggacataaaaccgtaagtgaaattattggattatatagcatttttaattttaaatattttgagaaacctccttactgttttgtataagggcaaacaattctaaattcccaccaactgtatagaaggagtcccattcctccacatctttgataaaatttgttatattttgacttaataatggtcatcctaatagggctgagttaatatctcattgtggtttcaacatgaatttacctgatgattagtgatgttgaacaccctttcatatatgtggtggccatgtgtatatattctttggagataagtctattcaaatcctttgtgcattttaaaatctagatatgtatgagtttttttgctgttgagttttaggagattattattatattcttggatattaactccttatcagacacatagtttgagaatagtttatcccattctgcatgttgtctttttactgtgttgattgtatataattcattgtgcagaaggtttttagttaaaattagtttcatgtgtctatttctggttttgctgcctgtgcctttagtgtcaaatccaataaatcattgccaaaaacaatatcaagaaaattttatccattttcttcaaggagctttacagtttcatgacttagtgtttaatacatttttagttggtttttgtgtatagcacaaagtatggagttccatttcatttttttgcatgtggatgtcgaccacaaatttggaagtggctatcctttctccagtgtgtgatcttgacacccttgtcaaagatcagttggctgcacatgcacgggtttatttcttggttctctattctattctcttggtctatgtgcttatctttatattagtatactgtttctattattgtagctttgtaatatattttggaatcagggaatgtgatgtctccagccttgttctttctcaaaatcactttggcaattcggagtcttctgtggctccacatgaattttagtattgttttttctatttctgtaaacaatgccattgggattttgacagggataacattgaatctgtcgattgctggtcataatatggacatttaacaatataatccttttctataaacagggaatgtctttccatttatttgtctagtttaatttctttcatcagtgttttataagttttcaatgttcaagttttatctttatggttaaatttattcctaagtattttatcatttttaatgctgttggtaataggattgttctcttaatttccttttcagatagttcattgttactgtgtagaactacaagtgatttttatgtattaaattgtattctgcaagtttgcttaatttcttgattaattcttacagatttgcgaagtctttgggagttttgtacatataggattataccatcttcaaacagaggcaattttactgctcctttaaaatttggatgcattttattttgctgctgttattgcctaatttctttgggtaggatttgtagtactacgttgactagaattggtataagaggaggcatccttgtcttgttcttgatcttagacaaaaatactttgagtttttcaccattcagtatgatgttagctgtggaattgtcatatatggacttcattatagtgaattcatcaacaattgttgacctcagaatataagccaaacaaagcagctttctttcacaattttccctcatgaaggctttgtaggaaacctgaggcaaagtttgaccaattgccttttctacaaatggactgctggtctaacagactacaaacttttgatatgtaaaactttattccgtatagtgttgatttttgtatatggatactaaccgaacctttaaaaattataattttatttatgaatatcaattctcattttattttatattcttgctattgttggtataagagaataatattgtttgtgtgtgtgtccatgcacaaattgatcattttttttctgtcaaccctccttaaatctcttataagttctctaatatttattgaataaataagcctgtgttgggtgtaatatatgtgagtgttttactatcttcatatatctctctaaatcctagacactagactttttagaaaactgttaagtacagaatctgctgaccttcacccaagaagttagtgtcttttatatttgctgcagtaaactacacatttccctgttagagaaatgagatcattttgattgcattattcttatttgctcctctcaatctggcttaggtaatttttatgggaaatcatcaaaaggcagcaaattattttaatgatacttgtggatttctaataacagatatgtatttaaaattccaaaatcttaattctgctaggacactggtttttctagaattgctccttaactaaatcctttcccaaagcaaaaagacctcaaaagccttgcaagtcttcaaaggttcatccctgttaaggtaaagaatttcatggcattgcaattctttatgtctcagtagggtattttccaataacatctcatcaggagacatttcatgactacttcattgtctcacctgatcaagagggattctctttacttctctataataacaacatgaagtctagagtgtgagtgtctttgactcaccagtagtgtatcatattaatgaaacaagcagttcactatttttcctggaccattttttaactcttatctcttatgtgtgatctatgtctgcttagtacatttgagtggagccacttcaaagatagttcatctctccctcaggaaaaaaaaagggtaaagtgtctcagaatttttttctgagggtaaaatcagcaaagtataatacaatgcaatacactgatgtcatcagaatccatacatagccatttgcagcatttactttcagctaccaaggaaacatagaatcaggctattcaatggtaatttctggaaaaaaattaacttaataacccttgaattatggagtaaaatttgattgtttcatgagtaaaaggactagatttacttccatttagatatatagtgacttataataactaaaaacttacagaatatcacattaaaaaatcttaaaattatggtttttatttcaagattaaatgtggactgcagttaatatgtagctgtgtatatagtatctaagtatgctataaagtaattttcaaaataagaaaatcattaatttatgaagacattactacccataaaatacttttcatatacatgtactaaacatccagaaatgtaaatatgaatttcagagtctgttttttcttttttcttagcaaaatattatttcatggaacattttttaatcacatttttcctcctttcctattctctctaaactacctatcacatagcctcttcctctatcctcttttgaaaatcattttgctgggatctcaattacctcttaattgcccagtctagagaagacagtgcatttaatgtcttctaagacctctcagttgcattgcatatttttgaccttacgctcattattgcaattcttctttgctttctgggacacaatgttttgcttatacgcatgccaccaccctgaaattctgtgcttggctttcttctcacttatattctctctctgagtcatttcatctatttctataacatcaaatactctttacaggcagaattctactaagtctatacagttggcccttgaacaatatgggtttgaactgcacaggtccacttatatgcaaatttttgtcaataaaatatacactgagtgtgcctgcctctctctaatgcctcctctccatctcctccacctcttctgtctctaccaccagagacagcatgatcaaaccctccttttcccccacctcctcagcctactcagcatgaagataaaggatgaagacatttttgatgatctacttccatacaatgaatagtaaatatattttctcttccttttgattttcttaataacattttttctatagcttactttattataagaccatagtatataaagtatacaacataaaaatatgtgccaattgactcatgttatcagcaaggctgtggtcaacagtaggatactaatagttagattttaaaggagtcaaaatttgtacatagatttttggctttgtgggtgtcagcacccctcactcccatgttgatcaaggtcaactgtattttcattgcagaactattatctgaattctggactattattatcaactctggttctgggcatcatatgcatcacatgctgaactcataagctctactccataagcatttatttacctactctgacctgttttagttagaagaaccatttttttctgttatattcttaagtctgaacctttcatgttccagatttagatttcactatcaaattctatttatatggagtatatcttgtctattttactccgtatttctcattcagtctgcttattagccacctaactagtgttttgttctttatttttatgcagtccattcttcacaattttagtagaataatctttcaaatattaaataagtacttcaacttaaattgatttggtatacaaaataaaataattggtttttgtaaaattgcaagatagttactcaaaatctagcaaatatttcttattgcatttgtgatgtctatataattgtataatcaattcttatacacaattgagtctctttctgggcaatcctttccaatccattgttattgttgctgatttgtggactgtgctactctatattatgtattatgcctttatgatttagtcagatattttaaaaatccatattcttcacaatagtcttttatttataaattactttttatatagtcacctattgatcttttttcaaataattttgtgactcccccagaatttcatttgaattgcattggagctatggtataatattgggagaactgattatttttgtgtatcattgcttttgaataatatgatataccaacccatttattctctcaaagtgttatatccctaaattaaaaaaaagttgtttctttatagatttcaaacagggaattagaaagaggattgaaagatcccttttcaccactttatttttcaaggcaaaattgtggcaagaatattcccttctaacaattttatataatttaggattggaaccagaaagttagtcattcattcttacctctcctctctaaagcacaactaattatctgtgactttttgaagtcactcttccctgaacatctaaagagagtgatttaaggtcaaatttgggcagagatagctgaaagtccattacaatttggtatttaataaaaaaatgtgaccttaatttgtagtcacaactggtggagtggggatattataactgcaatttaatttatgacaagatggaactgtaaaacatattttctttattgtctgctatgtttatatagtccaagagatgatccatgtctctgatggagtcaagctaacaaaacgaaataaaagactagtctttaaagtagaacgataaattattattttaaaatagcatgtatcaacttctagtggtcatagttgccaaataaaagtagtaatattagtaataatggctcttatttattaaaaaaatactctgttccatgcacagagggagtataataagccttacgtttcagagtttaggctctgttaaactttttaagttcagccttggctctttcaattaatcagtctatttcttggggcatataacttaacctccaagtgccttagttttatcattttgaagcactttaaaatgcctaagatagctgttgtggtgatgaaatgatatatgtaatgaacttagcatagtgcctgacacatactaaatgatcaatgcatgttaggtattacttagataacaaggataatattctgaaagtattaaatctattaatttaatctaatttaatttattcttatgttcatttaagttatattttcctgcattcttgctgttgttaagactaaaatatgagacttatcatccaaaataattttcttttttaccacccttgactctcaaaactcccttgaaataataaacccaggctttattgagggaaaaaatatatttttgcattttcttacaaactaaaagacagttctagtgtgctcaggtcaccaaacttttataataccataagtgaaaggaaaagagacctcaggatatgacattggagaaaggagaaggtatactcaggattgagagaataaagaaaaggttgggcaagaggtcctatttgagagctagggatggtagaaatcccaaatgagttgagggtgaagcccaaagcagaaggtcttagacctggttgtctgcctggaactgtgggtagaggccactaaatacgtgtctctgagctaggaaaaaaaataacagtttagtgagtttagagaatcataaacagagtacctggttctcttttgggtgttaggttttgagaacccagaaattctagcatactctcagaattgaagcaaggagttgaaagttagtggagctgtcctaggaccataaaggtaaaaggctggggagactttccaggagagcccatgaggtggattagtctttatggaagttacaactgatagtaaatgcacagctgatgataccttgggtgggacttattcattaaagcggggatttccctagggacgagactgaaagctgaacatgctgttgacctcaactggcatggacatttgctaccagaatgtccactgagcaagaatcactggaactaccactgttgatttagagggtggtacaaacacctacatttatgtcagttgctcctttagccaccaccagagaaataactatgccatatgggggtaaaaatataaataactcaaaaagactaatttttagtgaaagcattccagttcattcaaaagaaactgaattaatattagttgactaaatttgtactaatcatatctcattccaccatccacaaaaatggggacttcatgggaatctgaaaatagtattagaaagtaaagaattatgctcttttcccccatttaaggcatgaagtgtatgtgttgacacccaacacattagcattatcttattaagatatcttatgaaacaactacttttccctcctctattttgacaatttaaaaaacccaaaaccaaaaaacaaagctaattgaaacacaaaatgtgtatatgggcgagccaagaacaaaaccaaggagtttattgccacaatctgtgtgcctaggtgctattgtgccatacagggctgccatcagataccatatctagattgtctttgtacctttccactatagagttctttggttactctctcacagtgtcatcaccatagtatgtttcttactctgaaccatctcaccatattcctccccctcaaagtcttttctttggaactctcatgttatggctaacaactattggtcatcctctactttttcactgaacattcactctaccttgaagttttaaataaaatctgactatttccttagtgtccccttgatgctgttcttcctccaacatcatagtacctgagggctggtgagtggtcagggtcagatccaccttcattattaaaaatttcaggtcactattcctttatcttcatgttaaaattttgttcccttaaagtttatgattttcagtgattctcaaccttcaccattcatcagaatcattttgttaaaagagacagtagatgtgggctgagatctaagaatttgaattttctaacaagttgccatgtgatgctgatgctgcttcacagttacatgtatatcattttagatctaaatagtaataataacatctatagagattttagaggtgctgtttaatcttgaattgaatagaattatctcagcaattctttccttgttattaaaacctgaaacaatcttttaatttttgcagaaatttctacttcttaattctactagatattaattcgatgaattttaatgctacccatatatataactttgtatttttttcatatattagaaaggaacatgagtagcaattataaaatgctttatgtgagcaaatcaggtaattcatgattagaacagttatacactgatgtaaaattatcctgtttcagaagaatttctgcagtgtattctcctaggtttcatactgaatttcagtctttacaaaaccttctaaaagaccacagtgttcctttttttccctggtgttttatattatttatggtaatattttatgaagaatagtattttctcttttccattaatatttatatgtccattatcagccttttgcaactctcaatatatgtaatctcaataattatacaatgaatgaaaccggcaaacaacctccatgctttggattgctttgcaattttcttttcaatttatcgtttaggtacacaaataaattaacgctaacagcttgtgtcaaggatagcatatattaatatgacaattctaattaaaactgtgagttgactctcagttattttaaatgtcaaatgacaggcaaaacactgttttctagataaatacaacacatatctaaaagacagtttaaagcacaagtgtcagcaatggtaaaaacaatgtttgtaaccaaaagacagagaacaagattatctatatgttatttaggaaatactgacagaacaagattaaaaccaatgggggaataaagaatacttcttatcctccattatttgagtcctttgaaaatgagtgatccccattcctttgtgtaaaactacattcttttaattcacatatattatgggtctagataatttaatgttaaatcctatggttgttgtgattatacatataacattgaaataaacataaccaagatgaaaaccctgattttcttatccaggcatgttttgttgtggagaatggaaacaagtttgaattaacttatttaaaataagttatattttagtggtatcagtaaactcagggaaacataggagagtatcatgggaacttgaaattctttataaagctacttagcctttctgggcacaaattctcatattttctctttctgcctgttggcttgattcccctgcctctctctgtggcccagctctctgtgcttacatatcactgcattcttggcttatcagggctaacccatggcagcttcagtttctagtctgtcaaagctttcacctcagctccacacatttgagtaactcattctgtttctcaaatggaaattgccagaagagaaactgagcagctgattttgaatcagatacctaactccagttaaagtttggtcactatgtaagtgcaatattctaaatcttttctttctacctcaaaaaaacagaaaaaagtccagattccttaaaatgtgtagaatccatataaatcacattcctccactgttcttagtgattagatatttgtacattgttattattatatatttaccattagtattctcaaaagtggtttcgaaagtgccatgcagcccggctgagaatgcttgtggactttcactttcttgatgcttccagcttttcatccattctcattctaagttaatgactatttcttacatgtcatagataaatgcacaagagggaatttttccatcttcagaacactatacatatacctacctgcatcaacatctattctttccttcttccctcttgctatgaaggagtaataaaaatttctcctcccaaagctccaatacactttcatttaccctcttcaaatttctcaggggtcttatatctcagccacctctgtgatgaatattccttatcagaattcacacatatttccatttccatttatttacttattctaacttgtatttgaagttcgagagtacatgtgcaggtttgtaacataggtaaacatgtgtcatgggggtttattgtgcagattatttcatcagttatgtattaagactagtatccactagttatttttcctgattctctccctcctcccaaccttcaccttccaataggccccagtgtgtattattctcctccgtgtctatgtgttctcatcatttagctcctacttataaggaagaacatgcagtatttgtttttctgttcttgggttagttggctaaggataaaggcctccagctccatccatgtcccatggatgaagaatgagatcatgaggacatgatctcattcttttttatggctgcatagtgttccatggtgtatatgtaccacattttctttatccagtctatcattgattgtcatttaggttgatttcatgtccttgctattgtgaatagtgttgcaatgaacataatgtgtgcatgcatgtgtctttataatagaataatttgtattcttttggatatatagccagtaacgggattgctgagttgaatagtatttctgtctttaggtctttgaggaaccaccatgctctcttccacaatggttaaactaatttacacttctaccaacagtggataagagttcatttttctccacaacctcatcagcatctgttatttttttagtttttaataatagccattctgactggtgcgagatggtatctcagtgtggttttgatttgcgtttctttaatgatcagtgatattgggttttttccatatacttgctggccgcatgcatgtcttctttggaaaagtgtctctttatgttctttgcccactttttactggagttgtttgtttttcttgtaaatttgttaagttccttatagatgctggattttagaccttggtcagatgcatagtttgcaaaatttttctcccattctgtaggttgtccgttcactctgttgatagtttcttttgctgtgcagaagtgctttagtataattagatcccatttgtcaacgtttgcttttgttgcaattgcttttggcatcttcatcatgaaatctttgcctgtgcctgtgtcctgaatggtattgcctaggtggtcttccagggtatttatagttttgggttttacattgaagtctctcatccatctcgagttagtttttgtataagatgtaaggaagtggttcagtttcaatcttctgcatatagcaaataatctccaaaccacacaatccttccaaatgttgtcttttttacatattcgccctttacagttaagagtccttgaaatattttcctacagttttagatgtttcattctttgtttctcattcacttttcagcccactgtaatctgatttgtttacctaccatttcacaaaaaacagtccttgctaaataactgataatatccgtgttgcttaaaatagtaaacactattcactattaactttacttgacatttggcaagcatttgacattattggcatttccattatttttaaacataatcttatcttggtttctatggtgatgcattcttctcattttccttctacttttttggcctttcctggttagcctttatttatgtctcattttctttttccacatattatacttcttacaatatggtcttggatcttcatcttttatttgtctccactatttaaaagtgatcctaaccatttgcagatcttaaaataatacttaactgctaaaatcccaaggtatatttgtactccagaattctcttctgtgtctcacacacacacacacacacacacacacacacacacctcacgtacatacacagacataaatgtgtacgtgaaatctcccctcctatgtttaacaggaacttttcaagcacagcacttccgaaacaaaaaatatttacctcaaatcctctagttgccacatagttctctaattctcacctcactaaatatcctttttcatataattcttcatacagaaaacctgggagtcactactggcattttattgttcctaacttctcacatttcatctagatttcctcttctctctaccatcattagtagaactactctgtgctactatcacttcttgtttgcatttctgtaattgcctcttatttcttctaaatgcattttttcatagtagagtaaccagggtaatctttaaatttagcttttaaacaaatatttatgcaagatatgcatgtatatagttgaaagggtcattccacaaggtttgtaaaaacaaaacaacacaaacaaaaaatcaacacaaaacataaataatgactcatttttcagtttcaatttatattctacagatgcaaccactttcaaacttatcagctgtcttgtactacttagctctatctctctagataacattcctacaataatgatgctggtactactacttacttcttttttagttttatctttgctttttatttgttcatccgaaaatatcttttagtttcaaaccatagaacataaagttttagctcatatacctaatctctaccgaaaaatattgtccagccacacccttgattttctttccaaagcattttttctaatattacatctaatattagcatcttttgcaaactgaatcgactgaaatttttttaagccattgtgttggctttttgtttttcatgaaatttttccctcaatttatctccttcctttcatattttactataagcatccaaaaaaaaaaaactaggtctaccttcaacactttgcttgaaaatctcataaattaggccgggcacggtggctcatgcctgtaatcccagcactttgggaggctgaggcggacggatcacgacatcaggagatcgagaccatccttgctaagacggtgaaaccccgtctctactaaaaatacaaaaatttagccaggcgtggtggcgggcgcctgtagtcccagctactctggaggctgaggcaggagaacggcgtgaacctgggaggcggagcttgcagtgagatgagatcgtgccactgcactccagcctgggagacagtgagactccgtctcaaaaaaaaaaaaaaaagaaaatctcataaattaaatattcaattttataatttacaagttttgctttatacacaattgttaaacatgcttcattcagttttcaaccactacataacagggatcacctttactccagtttccaataatgtggtcctcatttcttcctgagccccatcagtagctgttttaacatctgtacttctatcaataatatcttcagggcattctaggctttttctctatattcttcatattactttcactattcttccatcttctaccccttgctcagttccatagccatttccacagtttgagttgtttgttaccacagcaccccatttcctagtatccaaaatctgttatattcccatggctactgtaaaaactacttaaactggaaggcttgaaatgggaaaaaattattttctcacagttcctaaggataaaggtgtaaaatccaggtgtcagcatgaccatgctccctccagaggctctagaagagaatccactgtttgtcacttccagtttctggtggctgtcagcattccttggcttgtggttgcatctctccaacctctcctctgtggttaagttgcccttttttctgtctacattaaatctccctgtgcttcactctgataaggatgcttattgaattcaatgcccacccagataatcaagaaccacctcatcttgatgttcttaagtgaattacatttgcaaagacccatttttccaaataaagtaacattcacagattccagggattaggatgtggacatacctttttgggagccaccattcaattcactacagtgtattaatactttatgtcctctgtccctgaaatactcctcccacatgtaggatactctattccaacgttctcaacactctcaacttatttcagctccactctaagtctaaaatcatatttaaataccatgaactcaaatgtccccaatctcattatctaaattatctaaatcagttatgagtgagactctgagcataatataccctgaggaaaacttcccctccatctgtggacctgtgaaatttaaaataagttatctgcttccaaaatgtaatggtgggagaggcataggatagacattcccatgccagaaaggaaatcggaaggaatagagtggatgaattacactaggtttcaagatctgagaatcatgctctgtggcttaatggaacctctgggttgtggctttgctttctgtgcccatgactctgccagcctttgtctttgtacccatgctttcaacctccagctggaggatttaccttcagagtcactctccctctttctggagagttggcatgtttggagctgagtaactttctcagcattttccttactgtagaactctggaagtttgacagacttcttccaatttctatctctgtctttttcagtcaaatctgatagactccaagaatcctggcttccagaacagtgagataatacatttctgctattttaagctatcctggttgtggtaatttgttacagaagccacaggaaatgaaaatagtattacacattacctggaaaggcatatacttcaatgtctgtctcagaaatactgtatagaaggtattttttgagacatcacttgtctaaaaatatctttccatatacatagcttatagttagggtatagagtctagtttcagaaatgattttctctcagaaatttcaaagcatcattttttctagttgtgataagcagaattctaagatgtccccctaagatctttggccccaggtatacacaaattatctcctagttatttaatcaataccaatcaaagtactgctatgaaggaattttggagatgtaattaatgtcccaaatcagttaactttaagactggcaagttatctggtagtgctgatctaatcagataagccctttaaatgcagagtttttctttggatggtcacctaagaggaagccatatatgtgtagaatgagaagatttcaatgcaccactgctgctttgaagatagagaaggccatatggcaaaaaaataaaaaattgaaaaagaaatggaggtcgcctctaggagttaagagtggcctctgcatgatagctaacaagaaaatgggaacctcagtcctacaatcacacacaaaaagctgaattttaccagcaacaatgagcttggaagcagactctacacttggtctccatatgagaattcagcttagttgaccccttaatttcagccttagcagataacccaaatatgccttcatggacttctgacctacagagttatgagctaatgaataggtgttgctttaggctgctaaattttttattgtgctgtggtagaatacttgtacaccagtcgtccatattggcatgtttttgagaaatctaaacacattatcatccaaagtatgatatttaatttcatcctccttagtaagatttttagaatcttctttttgacacactgttttgaaatttctaaattatatacatttaacaagaatctacttccattctttttttggggcacatgatgagctcttttaataaagaaaaatttttgcccctggaaaatttgttgaaatcattattattttttctttctgttttccctgtaatgtctttctagaactcccattattgatatgttgaacatccttgattaatataccaattttaaatcattttatctaatttttcatttccatgcattaatgatcttttccttcttgacttaacaatttcagtttctaacacttctattaagtttctcatttctgctatcataatattcattgccataaattccctttttcctctgattttcaaagtgtatagaatctagttgttttgtggacactctcctttttactctcagacaatattaacaagatttatttggtgtgtggtttccaagttttctcatgagcttctatttcctcttttttttctgttagtggtgttttgtctgtgtcttttatgttggggctttcttaagatgtctggtgctcttttactttctggtcatgcgtaagactacagtactcagtactgacaggagggtgttacatgtaggagagttgtcatctgactgttgtactgttgggtgattcagaagggctttcattggaaagtctccaatattgtaacttataaatcttttctctcactatggaaagaagaccataccagtaactgggattagaagagtgtaagccttacctttataattgtgtaaacaaatcacctggtcaatgctcaaggaacaggatgagggaagaaaagtatagtcttgatattcagtatatagcatttcatttagtctgttttcagtatggtacctctgcctgtccactctcagttcagagactctattttattttctccagagagtaagcatcctttttctgctgagggtagggcataatgtgggccagtggcctggctgtacaaagtggaaatggggaactgcagcagggatctggggtggcgtggggtgggcaactgcaacgaaaattttatcaaccaatattcctgggattggacccattctcatacttctcccaaggtattagagtttggagggcattctgaaatgcaaatcaaatcgcttctcagtttttacctctcctgacttgaaataagctttttattgttcaacatcagctactgcatatctttgtgatttccagttttcaaattttgctgccataatttttttctactgatctttgtccttataggtttgtggatgtttaaagcatattttattgctgtttttagcagagattaaacatcttccatatgttagaataatctttataaatcatatcatgacaaatttaaatatatcaatgacttccttttccattggaatggagcacaaaattctacctgtatagcccttgcttcatgcttctctgctatgttttgtaccattctgccttgatcaatctgctttgaatattaacctctttttaatttttctattatgctagattatttctatactagggtcttcatgcattcaattttctgtatgtagactgtttcttttattctccttaaccctttttctacatttcttaccaggttaacttttattcatttggtttaactataattctttctaggaggtcttctccacctcccagtcttaagaatgtctttctgttacattacttggttacattatcctatatatttttgttctttctgttgcctgacacaattagtaactatatcttagtgtgattatttcttgaatgtttgactctgctagtggtctttaacttcttgaagagaggaaatatgtattttttttattcaccagtgtatcagttaaagcctgttacaattacagccatgtaattagcattgattaagatttgttaagtatatgtataaatgagttgatgaatatgtagggatgcctctttcaggctgtgggttttctcaagaaaagtggacaatatgaggggataatgctgagaagttcttaactgaaaaggagagatgcaaaagagaacccacaatagtttctgaaaatgtaacataattgagggctctgccatatccctttctttgtatactacagttttctctggagaatttctgttattgtttattggctgtgtaattctgagtatgatgaatacattcttcaattcttcattttttactttctaaaattgcacaataatgtcttagacactagctttttcaagggtttctcattatgtacatgtaaagccatcaatattctgtttgccttgaatactgaatgcaattattaaacatattttcttttcttccttactttctctatgtcctgcattgattagatatgaggaagatatattttctaggcagtgaaagacttaaaacaaaataagttcccttgggacactgtgaaatttgcttttatagctgccttaaatattaggatagatttatctgtcagatcttgattgactaagccaggctgtggattaaatgaactctcaaggtctctttcaggcttgctgattctaaagcagaagaatagtataactagcgctagggatgtcattcattatgtggaacaatcctacttaccagtagcagtagcactataattgtccaaaaaacgtaactaatcttacaaggcttaaggtatattagaaaaaaatatcagaatagctaagagtcaaagttgtatatataatatccttgaagtcaggagatgctatcttatgcattctagattcatcaatatagagcacatgctctgacatggaatattggctaaagtagctattttagccaattaacaattaattacttggctaaaaaggaaactgcagcactttcttgttatgacagacaagaattatctaaacgctcagcattttgacattgcttttggttagtaatctttcttaggtcaatcttacccagccaacatatacaatttgaggacctattatatgcagagaactgttaaccttaattttaattttgtataatattggagataaatattactgcaggctcattttttctttctttgaagcttgacttactaagttgtgacttcttatgaaatgttaaaattggcaacactgagcagaaacagaagctacactgaactgaaaagtatcagctattacttcctagaggaggtgatattagagctgcccgttaaaaggtgctcaaaaatttgatagcttaagataaggtctggtccatatcattagtatcggcacaaagcatattcaggcaatacaaaataagctagctgtattgtaactgagttcacatagggtagttgttggagttaagatggaaagtaatttctaggcagcatctctatgtccctattctctctggttaatttggcaaactcctatttcttctaccaatatcagtttacttgtcttctgcgggggcaatcctactttgactccctgtagtacattaagttcccttacacctaatgtctacaggcttcctttgaaaatgttcaaaacttgcctcggggctaaagcgaggagatttgggcctggtagctatagcgctatgatgtagtgtattagttttggattatatttcatgatctacagaaaagactgtcttaatcatatcatcgaaggtggtctttgccacacctgatcaattgataagcctctttcaatacagtcacaggattgggtcagtttctgaatcattctattgaaaataggtagcagtaagaatgacagattttctgtatcagatttgctcagtaattgagctcaaatgctcagaatcaaaacaagcattggtgtttcagtttgtatgagaaatttcccaggcactcagttaaattgtccttagaatacagctgtggttgaaagataccatgaaagccattatcctgactgggcatttttggcacttagcaattacaaaggcttataaattctgggcagaaagaaaaccaaacttcttttacattaactcctgtagtatataagcaaataatgtgagtcaaggactcgctggaagttttttttttttttttttttttttttgagacggagtcttgctctgtcgcccaggctgcagtgcagtggcgtgatctcagctcactgtaagctccgtctcctgggttcacgccattctcctgcctcagcctcccgagtagcagggactacaggcacccgccaccacgcccggctaattttttgtatttttgttagtagagatggagtttcaccatgttagccagggtggtctccctgatctcgtgatccgcccgccgcggcctcccaaagtgctgggattacaggtgtgagccaccgtgcccggctggaagtctattttatggggaggagcttggagctgtagctttcctggaagtctgttatgcagagccagggctcactaggtcagctttgccaacggtttgaattgagagataagttgtgaccacttaggagaaacaatactgactttcagaaaagatcatcctcagacttatatgttggactttttttcttcaagtttttcaattatgtttataaagttgaatttatttgttttacctttaaatacatgaatatattgaggaactttgttccttgggtagaggttaaactgaaattgcctatatgtttcagattctttatttatttacagaatcctacctttagagaattttaatgtgtgtaaaatctaagtagaagatggtatggggtgtatatattgaaagtaggccaattctgtactctgttaagctgtgggaaatgtcctgatttttaaagttatggtattggccatatttatcttcatttcagtttgttgtgtttctcttctggtaacagcacaggaacaaaatccatagttttcaataaggagtgactttgacttattttaaatgaatatttacttcaaattatatcaatttgtttctgttggcaaagtttctaaaatagaaaagtatcttctacactttatctatttatgtaaagggctaagatattctcaactacggtgtcaaaaaactcaatttgaggttgttgcctgttttagggaaatggaaaagcaaacgctgatactgatacccactttataaggaaaggtattttgaaagtttgttactttctgtataaatttctatctcagggtagaaaaaatagaaatagcttaccaagtagcttacttattttagaaagtttgttttttatctttgaaaattttttacctgcagacttttttttcttagatgttaaatgaatgaaacaactgttaaagttagtgggaaaaagatttcctgaaaattgtgaaataattacttgaatcaacgtttctttcatgaagtacaaaaaaagattaatgaagattaattttataatagaactttaggatttaatgccactagtatcagaaatttttctacatttgctaaatgtggaagcccttgttagagtcctggtttatagaaatgagggcaatgtatattccatttcatgttctagaaaaccattttgccgtctaacatggccttccagttgtgtaactgcagccaaatatgtagttcttaaaaatattttcataaggtagaaaatttttctattgcagttgttgagattgggttaaagcaacaacaacaaacaactatttattagcaaaagaaaaaaaatgaataaaataaggttctttgtatacattccaaaacacacaaacaaacaagatatgctcctttaactcccttacattttccctaaaactttgctaaacaatagggaggagttatcttttccttttctaaaagggaaatagatatgcccttaacttaatcgtatttatatacagccctgcaaatgtatttatttaaagggcatcaaagtcatattatggtttctaaaacattgaactttgctatctaagactgaaaaaaatgatctattcttgatcagctttatatgaccattttatttgattgtttaccaagaagatatttttagttttatatcaccattccttttgcacttcgtccttggttgaactagctcactgctaagaattctcaggaagactaaactcaatttagcattagtctaagaaaaatttaattagaaatatgatacattggttgcataataaatcatgtaataaattcctgagctcatcatgaaggattgtgagttatgggctaatttgaataatccaggccaactgagaattgcctcactgtcgtttgtatatgaagaaaagcaaccctatagtgactgatctgtttttactgtcagttgaagtgatttctaaataacaagttagaaagtgttgctgagaagctagaatgaaggatttacagaaacgttttactctttgagatttctttacttattacccctgtaggattactaataatgtagttcaggccagtcagcattaacattcatatgtcttttgtgcagacagaaatgcagggtgccatggaccctatacctatggatatggtaatggtggggaccgcagagaggggaaaatggaatgtgggtgggatagaagtctgccaaataagataatatgcagtgtattcatcaagagtcataggcttaaatgcctttaggactgtgttagcatcctagtgactggaagaaaacatgcctcatttcagaagtcccacctccagaatgcattgcattgttgcattgagtgaatccaatcttagtgttgctaaagtgtgagatccaccaataaatgaattatatccgagatgaagctcagcattcatttacaggaagcaacaaaatatagaaatttaaaaatgtaacatttgctaatctcttgcaacaaataaaaaatcactagccaagcaaataaatagaaaaatattgctcataataaggagaaaaatcagtcaatagaaacagatttagaaatgaaagatgatgggataagaaggcaaaaattttaaaacagcttatgtaaatatgtgcaaaataaacataaaatattatgaatagacagttgaccaagggaatctaattaaaaataacactttcactatggaagccaaataatttgttgcctaatgatgtcatccaaaataaaactcatgagttttgatgtgtatgtgtgtgtgtatgtaacttgaaatatagatacaagctgtctaaaaagcaaaaagtattattttggacctccaggctcagtaatgaaacatatgtgtgtacaaattaccagatagagatgatgtgttttgaaagggaaataggtttttttttttcttaacacttcagcagtagttgtatgacaaacacatacataaatccacagagatttaccccgttttagatatattgaattcaaatacgtgggatatatttgtttgagtctttaaacatagcatccttgcagacgtatctaagtgaaaaagttgaccctgaaaaagatagaagaaaaaatatttcattttcattagtttgctcctctagtaagaactatttgaaagttaaaacttgtttatttttcttcagagagatagttgaagaaatgagaggagaaggattgttgagctaaatcctagaagcaggctcttgacttttacagaaactaaactcttgggttcaagggatagtttctccaacttacccaaatgactaatttagaacaacctgtgctgtgcagatactggcaagaaagaagatttaacacttcctttcagtattgaacaaaaattgggataatttataagttattcttattttagtgatcttgattcaaaagatacacaaattcactttagattaaccaaaccaagtagattgcattgtattttgtgagcacaattaaggtctgaatttggtataggccattgcaatattatcaagtaattccactttaaacatttcccaaagggaatgtctgctgtctcactctatttttgcgtttgtgtaatctgcctggttctcacccttaactttctaattccttgggcttgtggaagagcttgatttgtaagttagttttgttctggtttttggtttgctgacagtattgtttctctccttttctccaataagattttaccctgattttagttctaatagattttataacgtagagcacctcttctttgagtcatgaaaacactgttactaaatgttacatagaaaacctgtgggtaaagaagggaaacatttagctgcctctgaaaagcctctctatcccaagtctctgaggcaagtccatggacctttagatcttttgaactttagtcttcttgtcagcaaaatagaaataatacctattctatctaaataggatgtttgttaagaggattataataaaatgagtttatttatcctatggtaaaaatgtatcctgaactttgataattttaattaggttgtcattattgtccccataatatattttacaaatagaaaatgaagaattgcaaatctttaggcttagcttttctagatgaagcagtattctgcactaaggaaaaatgtgttcttgagatggctagagagacagacaagctcagttttccactgatcataaggaaattacctttcctctttcaagtgtgtgcattcatagacaaatatctaaatgttttcagaagagctttaggtttaaataattattgtgaagatagtacatagagttcctgtacaccccacaccaactatcctctattgttacaatctcacattagtttggtacatttagtaaagtaaacaaaccaatattgatacattattaactaaaatatataatttattccaatttctttagcttttactcgacatccttttttttgctattctaagatcctatctagaacaatacattatatttttcatcatgtttcctacacacctcttgactgtgacaattttctcagattttctttgtttttgaggatcttgactgttttgaaaaatattggtatagtaattttcagaatgtacttcactgaggtttttctgctggtcttttatgaccatatgggtataatgtgtttttgagaggagggccacagaggtgaaatgccattttcatcccattatatcaaggatatatgctatcaatatgatttattactctggttgctaaccttgatcatctgacttgatatagtgtttgtcagatttgcccactgtaaagtttttctttttgcttcctttctattctgtactgtttgggaataaagtccacacttaaggagtggggagttatgccccacttccttaaggacaaagtatctatgttaataatttgtgattcttatgcatgggagattggtgattggtttattctcccctatttatttattgattcatttatgtatctcaaaatggactatttattatatactttaggttataagccccactatttcatttgcttttgctcatttttttttcatctttggccatttggagtcctttcattcggcctaaaatgctccaggctcatattctgtatttcctgccccagtcctagtatcagccatttttcccaggagctctggctcttttaatcagaaaaggtcttagaaaccaagatcttgtgctaagtatatgcattgctactgatgtgtcattgtttctagatctgttcacacagacagtaatggagatatacacatatatactaatataagtatattcatatatatgtaaaatatgtacatatttctacatgtagccatctatattatactgtaagttgctgaacatgacttcatactgatgtcttctatgttaacttaactcgttattgagaggtgaagccagctgggcttctgggttgggtggggacttggagaattttgtgtctagctaaagaattgtaaatgcaccaatcagcattctgtgtctagctaaaggattgtaaatgcaccaatcagcactctgtaaaaacacaccaatcagcactctgtaaaatggaccaatcatcactctgtaaaatggaccaatcagcaggatgtgggcagggccaaatacgggaataaaagctggccacctgagccagcagcggcaacccactcgggtccccttccacactgtagaagctttgttctttcgctcttcacaataaatcttgatgctgatcattctttgggtccacacgacctttatgagctgtaacactcaccgcgagggtctgcgccttcattcctgaagtcagcaagaccatgaacccaccaggaggaacaaacaactctggacccaccacctttaagagctgtaacactcactgtgaaggtctgtggcttcactcctgaagtcagtgagatcacgaacccagcagaaggaagaaactccagacatatctgaacatatgaaggaacaaactctggacacaccatctttaagagctgtaacactcaccgcggaggtctgcggcttcattcttgaagtcagtgagaccaagaacccaccggaaggaataaattccaggcacattttggtgaccacaaagggactttcgcctattgccaagcagtgagtatcatcagaccccttttgcttgctattctgtcctatttttccttagaatttgggggctaagtactgggcacctgtcggtgagttaaaagtgactagcatggctgccagactaaagacatgggtgtcaggatttctgggaaagggctctctaacaatccctgactctttggagttgggagcgttggtttgcctagaaccagcttctgcttttcctgtacttctgggctgagccaagagtcgacaagagaggaaagccgttcagatccggggtcctgacaacaagttggttagccctgcggccatgagtggaactctcaaagtcttgtcgcccaagtgagactcacccatctatcctatctatcctgacccttgcctcctgggtcctaatgcctgtcagacaaacttcctcttgcctctcttctccaaggctagtcccgcttctaaaaaccactgtctctggtgcttttcttgtttctcctataagaatgatttctggtacaaactccaggactctattcccttctttaggcacctgggcttcccagtcagaaagacataatttttgcccaaagtcccgtcataggggggactatctggaattttaggatccctcctcaaacaagctggcctaacaaaagctattcctgaagctaggatatggggagcttcagaaatgatatccttcctattcaagtgaggacaaaaggcatcactcttctaaccctgtagatcccttccctccctcagggtatggccttgcacttcatttttggggcataacatctttataggacaggggtaaagtcccaatactaacaggagaatgcttaggattcttaacaggtttttgagaatgcattcgtaagggccactaaatccaatttttctcagtcctctttgtggtctaggaggacaggcaagggtgcaggttttcaagaatgtgttggtaagggccactaaatccaacattcctcggtcctccttgtgctttgggaggaaaactagtgtttctgctgctgtgtcagtgagcgcaactattccaatcaggagggtgcagggactgttgcaggtttttgggcaagagatgtttctgctgctgtgtcagtgagcacaactattccagtcagcaggttccagggactgttgtgggttcttgggcagggggagaaacaaacaaaccaaaaccatgggcggttttgtctttcagatgggaaacactcaggtaccaacaggctcacccttgaaatgcatggtaagccattgggaccaatttgacccacaaaccctgaaaaagaggtggctctttttttttttttctcactatggcccagccccagtattctctctctgatgggaagaaatggccacctgaaggaagtataaattacagtactatcctgcagcttgaccttttctgtaagagggaaggcaaatggagtgaaataccttatgtccaagctttattttcattgtaaggaaaatccacaactatgcaaagcttgcaatttacatcccacaagatgacctctcagcttacccccatatcctagcctccctatagctccccttcctattactgataagcctcctctaatctcccccacccagaaggaaacaagcaaagaaatctccaaaggaccacaaaaatccccaggctattgcttatgtccccttcaagctgtagagggaggggaatttggctaactcaggtgtatgtccccttctccttctctgatttaaagcagatcaaggaagacctggggaagtcttcagatgttcctgataggtacatagatgtcctatggatctagggcaaacctttgacctcacttggagagatgtcatgctattagatcaaaccctggcctttaatgaaaagaatgcagctttagctgcagcctgagaatttggagatacttggtatcttagtcaagtaaatgatagaatgacagccaaagaaagggacaaattccctaccagtcagcaggccatccccagtatggatccccactggtgtctagactcagatcatggggactggagtcgtaaacatctgctgacctgtgttctagaaggactacggagaattgggaaaaagtccatgagttgttcaatgatgtcttttataactcagggaaaggaagaaaatccttctgccttcctagagcggctatgggaggcctcaaggaaatatactcccctgtcacccaactctcttgagagtcaattgatcctaaaagataagtttattacccaatcagctgcagatatcaggagaaagctccaaaatgagccctgtgccctgaacaaaatctggagccattgttaaacctggcaacctcagtgttctataataggtaccaagaggaacaggccaaaaaggaaaagcaagatcagagaaaggccacagccttagtcatgaccctcagacagacaaaccttggtggttcagagaggacagaaaatagagcaggccaatcacctggtagggcttgttaccagtgtggtttggaaggacaccttaaaaaagattgtccagtgagaaacaagctgcccccttgcccatgtccacaatgctgaggcaatcactggaaggtgcactgcctcagaggacaaaggttctttgggccagaagcccccgaccagatgatccaacaacaggactgagggtgcctggggcaagcatcagctcctgtcatcaccctcacggagtcccgggtaggtttaaccattgaaggccaggaaattgacttcctcctggacagtggtatggctttctcaatgttaatctcctgtcccgacagctgtcctcaaggtctattaccatccaaggaattctgggacgggctgtaaccaggtatttctcccacctcctcagttgtaattgggagactttgctacagatagtaagtatgcttatctaatcccacatgcccatgctgcaatatggaaagaaagggagttcctaacctctgggggaacctccattaaatatcacaaggaaaccatggagttattgcatgcagtgcaaaaacccaaggagatggcagtcttacactgctgaagccatcaaaaggggaatgagaggggagaacagcagcataagcagctggcagaggcagcagaaaggaaagcgagaaagagacagaaagtcagagaaagagagagagaggaagaaacagagagacaaagagaagaagacagaaagaggaagagacagagacaaagagtcagagagagacagaggaagagacagagagacaaaaagtcaaaaaaggaaagagaggaagaaacaaagagggagccagagatagagagaaagagagagagatgaagtcaaaaagaaagaaagatggaagtagtaaagataaaacagtgtaccctattcctttaaaagtcagggtaaatttaaaacttataattgataattgaaggtcttctccataaccctataacactccaataccaccttgttgtcagtgtgaacaagggcatagcctgaaagaactgaggccacagaaaacccatagccttcctgtcaaaaatccttaacccagcaggtttcctaacagggtatctaaatcttaattaattaccatacaagtgtcctaccagatgtaggaagaactcccttcaggacaggacaatagatggttcctcccaggtgattaaggaaaaaagacacagtattcagtaagtgataaggaaactcttgtagaagcagagttagaaaaattgcctaataattggtctgctcaaatgtgtgagttgtttgcactcagccaaatcttaaagtacttacagaatcaggaagcagccatctataccaattctaagttaatatggactaaacgaggttttattagtagcaaagaaaaattaaaatcccaaacttacaaggttttcaactaaagtttgccaaaagttaacagtgtaacatgtattatcctactatcacacactctcaaaggatttctcagacagtttgcaagaaataacgtaatctatccttactctacagtcccaaatagactctttggtagcagtgactctccaaaactgccgaggtctagacctcctcaatgctgagaaaggagaactctgcaccttcttaggggaagagtgctgtttttacactaaccagtcagggatagtatgagatactgcctgacgtttacaggaaaaggcttctgaaatcagacaacgcctttcaagctcttataccaacctctggagttgggcaacatggcttctccccttgctaggtcctgtggcagccatcttgctattacttgccttcgggccctgtatttttaacctccttgtcaaatttgtttcctctaggatcaaggccatcaagctacagatggtcttacaaatggaaccccaaatgagctcaactaacaacttctactgaggacacctggactgacccactggccctttcactggcctaaagagttcccttctggaggacactacaactgcagggccccgtcttcacccctatccagcaggaagtagctagatcagtcattgcccaattcccaacagcagttggggtgtcctgtttagaggggggattgagaggtgaagccagctgagcttctgggttgggtggggacttggagaacttttgtgtctagctaaaggattgtaaatgcaccaatcatcactctgtaaaaatgcaccaatcagcactctgtaaaatggaccaatcagtaggacgtgggcagggccaaataagacaataaaagctgtccacccacccgagccagcagcagcaacctgctcaggtccccttccatgctgtggaagctttgttcttttgctcttcacaataaatcttgatgctgatcactctttgggtctgcactacctttatgagctgtaacactcaccacgagggtctgtggcttcattcctgaagtcagtgagaccacgaatccaccaggaggaacaaacaactccagacacaccacctttaagagctgtaacactcactgtgaaggtctgcggcttcactcctgaagtcagcgagaccacgaacccaccggaaggaagaaactccagacacatctgaacatctgaaggaacaaaccctggacacaccatctttaagagctgtaacactcactgcaagggtctgtagcttcattcttgaagtcagtgagaccaagaacccaccagaaggaataaattctggacacattatcacatggattattttagccttcttcaccattgtattagttacctattgctgctgtaacaaatgaccacaaactttgtggcttaaaaaacacaaattcactatgtaatagttctgtgggtcggaaatagggcagtctcatcagattataatcaagatgtcagtagggctgctgtgttctttctgaaggacctataggaaaatatattttcttgccttttccagcttctataggctacatttgaatgtttctaacagctttattattattattattttgagatggagtttcgctcttgttgtccaaggtgaagtgcaatggtgtgatctcggctcactgcaacctgcgcctcctgggttcaagcgattctcctgcctcagcctcccaagtagctgggattacaggcacgtgccaccacacctggctaattttttgtatttttagtagaaatggggtttcaccatgttagcctggcttgtctcaaactcctgacctcaggtgatctgcctgcctcaggctcccaaagtgctgggattacaggcgtgagccaccacgcccagcctaacagctttattaacatcacctcaaactataagctcatataaacatttgaatgtatgacattattttttaaattgattgggtaaatacctaggagcacaattgctggattataaataaagattatatttagttgtttaagaaactaacagactgtttccctaagtgggtgtatcatttttcattcccaccaactacaaatattcattcctgttactccatatactcactagcagttgatattgtcagtttttaaaatctctgtcattctgatgcatgtgaagttatatatcattattgttttaatttatagtttgctaatggcaaatacttttgaacatattttatatgcttatttgttatctgtatattttctttggagaggtttagtttctggtattatgcccatttaaaaattgtgtttctgttttctttttggtgaattctaagagttcttgggcttggtgtaatggcacatgcctgtaatcccatatacctgggtggcaggagcagaaggatcacttgagcccaggagtttgaggccagcctgggcaatgtagcaggacctcatcttaaaaacaaaaacaataaaatgaataaataaacaaaaacgagttcttggtgtattttggttacaactccatatcagttatgtgtttaacaaatacatttttccagtctgtgggttgtcttttcattcactaatactttttgacaacgcagaatttttaattttaataaagtctattttgtttatttccatggagtaatgtcttattttaaaactcatcaccaaacccaaggtcagtagattttcctttatgtcttcctcaataagttttatagttttgcgctttacatttaggtctatttttcatgttgagttaactgttaggtaaaatggctggatcaaggttctttttttctttcatatgggcatccagttgttctagcaccatttgctggaaagacacatattggatttgctttaatctgatatcaaatatcagttgattgtgtacctatgagtctatatctggtgtcttcgtccatttggggtgctatagcaaagtaccacagactgggtagtttataaacaataggaatgtattatttacaactcagcaggctgagaatttaaagatcaaggtgccagcagatttggtgtccagtgagcgcccactttctaactcatatatggtgccttcttgttgtcactttacatggtggaaggagcaaacaagttccctcaggcctcttttatggggacactaatccagtgatctgattacctcccaaaactctacctcttaatagcatcacagtgtggggtaggatttcaaaatacaaattttgcagtgacacaaccatttgaaaacacagaatcttggttctttattctgtttcattgatggatgtgactattttttcaccaggagcacaccatcttaaataatgtagcattacagtcagacttgaaatcaggtaaagggagttctccaacttcctttttcttcttccatgttatattagctcttctaggaacttttcctttccatataaagattattattaatttgtcaatatctacaaaatagattgctcaggttttgtctgggattacatttaatctatagatcaagttggaaaaatttggcattataacgatattgagtcttctaaaccccaaacacagaatatttttccatttcttaaaatcattcatttttatcactgttttgcacttttgtttatgagtcctgtgcatcttttgttggatttatgcatatttcaacttttgtgtgctattttaactattactttttaaaataaatacattttatattccaattgttgattgctgatatattggaaagcaattgacttttgtatattaaccatgtatggcacaatcttgttattcccatttactagttacaggacttttttgacaattatttgatattttctacatagaaaatcatgccatctgttaataatgacagttttatttcttcctgtctaatctgtgtaattttatttatttttattgtcttattgtactagctaaaacttcccatttattccctttctactcaaggacattgagtaggactggtgaaaggaggcatatatttgtcttgttcgcagacttagataaccaacatccagtttctcaccattaagtagggtattcacaataggtagttaccgaattactgtatcaaattaaggaaattaattttctagtgttgagatggcttcagtggtcacagccttgtggaaaataagtcagttgccatacaatccctggaatggcctctgaagaaggacaggcataaagtcaacagtggaggctaaaataaatacctaatcccttaatgcacagatatagacttccacaggcaccaagaatattcagggaaatatgaccttacaaaataaaaaaaataaggtgtcagaatgactgtaaagtgatggagatttatgatctctcaggcaaataattaaaggtatctgttttatggaagctcgatgactgtcaatgaaagacagagaatcaatccagaaatcaaataaaaaatttaaagctatctagggactaaaaggttaagtcaccaatcagattcaactcaaataaaaacaccccaggacgtattataatcaaactctgaaaggccaaagacaaagagagggtcatgacaacagaaaaagcaaataatatataaatgagatcaaatatttcttgtagcatacatcttagcagaaattatgcaggccaggagggagaggaacaatatattcagaatgctgaatttaaaaaaatgaagccaaacagtagtaatttaaccaacaaagtaaatcatcagaaatgaaggaaaggtaaagattttcctagacaaaaaacaaagttgagggaatttattcctatgagaccagttttacaaggaatgctaaagggagttctttaaaacaaaaataaaaaatgttaaagtgattgtgtgattgctatactaatattgtaatcatagtgtttaaaccacttctatgtttagtaagaagtctaaaaaataccattaaaataataactacaacaaatacttaggagataggtaatgtaaaaatgtaaatcatagcatcaaaaattcaaaatgtgggaggaggagggaaataataggtgcagtttttttttggtttggtttggttatttcttttatttcttgtcataaaaaagttggtatcagttttaaatatttgctataactacagtatgtttttctctaagcctcatggtaaccacaaagcaaaaatcaatcatagatgtactggaaaagcaacaaatttataccagagaaaataaccacaaaaaaagacagtaagaaaagaagagaggagttaagaaaaacaactagtaaaaaaagtaataaaatggtagtagtaaggccttacctatcagtaataatataaatgtaaatggactaaattatccaacaaaaagacatagaatgcatgaatggataagaaaacaagatataaaaatatgctgcatagacgaaactcacttcatttttaaaaatatacatagtcaaagtgaaggaatgaaagaagatattttatgcaaatagaaactaaaagagatcaagagtagctataattgcatcagataagatagatttttggtcaaaaaatataaaaagagacaaggtaattatatgataaatgagtcaattcagcaatggggtataacaacagtaaattatatatataaagcaaataataataagtctaggatttagagccaagatgactagacacagccaagaagaacaccttcaagcaagagagacaagaacattggtaagaccagcactctgtaaacatcttcagagggaaggtactgacagtggatggaggggggatgtagatcctcgaatgaaggggaaggaagataggaactctgtacagggttgctgatcactggaactcattccttgcccctcgaggttcctggagaaaggagtggcatgcttgtaacacagagctctggaatcctagctgcaggaagcctgcaactcctgtggtcacttgagctggcaaggagagctgcttggagaggtgataggggcaggactcaagtctgtgcatagcccagagggtttggcgtggagcacagccagggactcctatcccccaaggctcactgtgcttccaaatgtggctctggcctttgatgatgtttcaatctagaaagaactggaagatatttcctgtgggatgaggccactctgatctgaaaacacccctgtcttctggcctcttctgagccacagcctggccacacctgcttgcaatgcagccccagatgcccaaccagtgtgcttcctgagtgtcatcacatagctccttcactgacatactgcacctgaccatcagagagctccagcagacagccctggctgacaggcacccacccacctgcagcctccctctgacactttgccagtgcgaacttgcagacagcccacctccactactttgctggcccacactcacaggtggacatttgttaacagcgtctgtcatgctactgctaaggtgcgagcacacacatggacaccatagtactctcctcaccagcatgccaaccccaaaaacttgtgagcaccctgccatgccactgctattgctgatgtgcataagcaagcacagatcctgctgccactgcccttatgaagtgtattggccagcaccccccaatgaagtgttgttgctaatggaacaggaatatgttggtccctccaatgtagcaggtccctaaccttgaggggccagagaacaaagctgggggcctggtaccagccccctagtgttagagcacacagcccagtagtgctgagctgaggtttggtcccctaaattcttccagaaattaagccagtttagtgaactcaccttataccacaatcaaaccttcaagggcatcaaagaggaaaaaagcaaaaatattcagaggacagcaatgtcgaagactaaaggaacatcagcccacactgttaagagaaccagtactagacctccagcaactcaaagccagagtgtcttcttacctccaattgaccacactagttccccagcaaatagttcttaaccagacttaaatggctacaattacagaaatagaattcagaatctggattggaatgaaaatcatcaagattctggagaaagttgaaacccaatccaaggagtctaaggaatctaataaaatgaaacaagaacataaagattaaatagccattttaagaaagaaccaaattgatccaatcaagccaaaaactcactacaagaattttataatactgttataagaattaacagaagaatggacccagctgaggaaagaaacagagcttgaagactggttctttggatcaatgaagtcacacagaaataaagaagaaaagaatatagaagaataaacaaatcccccaaggaataagagattctgtaaagggacccaatctatgactcattcgcatgcttgaaagaggggaagagcaagcaactaggaaaaaatatttaaggatattgtccatgaaaattttcccaacttcactagaggggccaacattcaaatataggaactgcagagaacccctgaaagttaccatacaggactaccacccttaagacacatagtcatcagatataccaatgtcaacaagaaagaaaaaatattgaaggcagctagggatacagggcaggtcacttacaaagggaaacccatcaggctaacagcagacatttcagcagaaaccttacaagccagaagagattaggattctataattcagcattcttaaagaaaaattccaaccaagtatttaatatacaaccaaactaagcttcgtaaacaaatgagaaataagattcttttcagacaggcaaatgctaacggaatttattaccactagatctgccttacaagagatctctaaaggactgtaaaatatggaaaagaatgaccattaccagccaccacaacaaaacaaaaacaaacaaaaacacttaaatacatagaccattaacactataaagcaacaacaaatcaagtctttataaaacccagctaacaacataatgacagaatcaaatctgcatatataaatattaaccttgaatgtaaatgggctaaatgccccaattaaaagacacgggatgacaagttggattaaaaaaaaaagcaagacctaatggtatgctgtcttcaagagacccatctcagatgcaatgacattcatagtttcaaagttaagggatagagaaaaacctaccaaggaaaagaaaaaacagcagggtttttccccctaatttcaaacaaaatagaatttaaaccaacaatgataaaaaaagctaaagaaggacattacataatgataaagttttcaattcaacaagaagacctaattatcgtaaatatatatgcactcaacaagggagcactcaggttcataaaggaagttcttagagactgtgaagagacttagataacaaagcaataataataggagacttcaacacctcactaacaatattgacctgatcttcaaggcagaagactaataaagattgtcaagaccttgacacttaacaaaacaggcctaacagaaatctgcacaactctccacaccaaaataacagaatgtacgttcttctcatctgcagatgacacatactctaaaataggcctaacagaaatctgcacatctctccacaccaaaacaacagaatgtacattcttctcatctgcagatgacacatactctaaaattgggcacacattttgccatcacaaaattttcagcaaattaaaaataaactgaaataataccaaccacattgtctgaccccaacacaagaaaaatagaaataaatacaaggaggatcactcaaaaccatacaattaaatggaaatttaacaacatgatttggaatgacttttgggtaaacaatgaaattaaggcaaaaaatgaaaaaatatttccaagtaatgaaaacagatacaacataccagaatctctagaacatagctaaagtagtgttgatagggaattttatagcactaaacctccacatcaaagagttagaaagatctcaaattaacttatcatcatgcctagaggaactagaaaaataagagtaaaccaaccccaaaggcagcaccaaaatcagaggctgaactaaatgaaattgacatggtaaaaaacacacaaaacagcaacaaaatcagactttggttctttgaaagaacaaataaaattggtagaccactagttagactaataaaaaagaagataacataatcagaaataacaaaggcgttatacccttgaaccgacagaaatacaaaaaaccatctgagactattacaatcgtctctatgcacagcatacaaactggaatacctacaaaaaatgcataatgcctggaaatacacaaccttccaagattgaaccagggcgaaatttaaaacctgaacaaaccaataatgagttctaaaattgaattggtaataaaaagcctaccaacaagaaaaagccctggaccagacagattcacagttgaattgtacaaatgtacaaagatgtagtaccattgcaacttaaattattccaaaaaattgagggcagggacttctccttaacccatatgaggccagcatcattctaataccaaagcctggcagagacacaatgaacaaagaaaactacaggccaatatccttgatgaacacagatgcataatttctccacaaaatactagcaaaccaaatccagcagaacatcaaaaaactaatccaccatgatcaagtaggctttatccccgggatgccaggttggttcaacatatgcaaatcaataaatgtgattcaccacataaatagaactaaaaaacaataaccacatggccatttcaatacatacagaaatggttttcaatacaatttaacattattcatgttaaaaaccttaaaaaaactagtcattgaagaaacatacctcaaaataataagaaacatctttgacaaacctacaaccaacaacatactgaatggcaaaggttggaagcattccccttgagaaccagaacaagacaaagatgcccactctcaccactcgtattcaacatagtactggaagccctacatggagcaatcaggcaagagaaagaaattgaaggcattcaaagagaaagggaggaagttaaactatctctgtttacagatgatatgattctatacctagaaaaccccatagtctctgcccaaaaactcgtaggtttgataaacaactttagctgagttttaggacacaaatattaatgttcaaaaatcggtagcatttccatacaaaatagcatcaaagctgagagccaaatcaagaacacaatcaaaatcacaatagacatacacaaaaatataatacctagaaatacagctagctagggaggtgaaagatctctacaatgagaattaaaaaacactggtgaaagaaaacaaagataacacaaacaaatggaaaaacattccatgctcatggataggaagaatcaatattgttaaaatggccataccattcaaagcaatttacagattcaatgatatttctatcaaactacctacaacatttttcacaaaattagaaaatctgttctgaaattcatatagatccccccaacaaagctcaaatagcaaaagcaatcctatgcagaaaacataaagctggaggcatcacattccccaaattcaacttatactacaagtctacagtaaccaaaacaacatggtactgctacagaaacatgcacatagaccaatggaacagaatagagggtccagaaataatgccacacacctacaaccatctgacctcagacaaagtcaactgaaacaggcaatggggaatagactccttattcaataaatggtgctgggataactggctagtcacatgaaaagtatttaatctggaccacttccttttactaggtacaaaaatcaactcaagatggatgaaagaattaaatgtaaaacttaaaattacaaaaaccctagaagaaaacctaagaaataccattctggatattggccctggcaaagactttataataaagattcaaaaagcaattccacagtaacagaaacgatcaacagagtaaacagacaacctacagaattgcacagaaaaagaaactatcaacaaagtaaacagataacctacagaatgggagaaaatacttgcaaactatgcaactgacaagggtctagcaaccacaatctataaggactttaaacacatgaacaagcaaaaaacaaacaactacattaaaaagggggcaaaaacatgaacagatacttctcaaaagaagacatacacatggcaacaaggccatgcgaaaatgctcaccattgctaatcgttagagaaatgcaaatcaaaattacagtaagatgccatctcacatcaatcagaatggtcattattaaaagtcaaaaagtaacaaatgctggcaaggttttagagtaaaagtaacgcttatacgctgctggtaggaatgtaaattaattcagccactgtgaaaagcagtttggctatttctcaaataaactaacaccatctgaatcagcaatcacattactaggtgtatatccaaaggaatataaataattctataataaaaacagatgtatacatatgttcatcacagcactattcaaaatagcaaagacatgcaatcaacctaaatgcccatcaacgatagactggataaagaaaatgtggtacatattcaccatggaatactacagagccataaaatgaacaagatcatgtcctttgcagcaacatgaatggagctggagtccattatcctaagtgaactaatgtagaaatagaaaatgaaatactgcatgttctcagttataaatgggagctaaatattgagtacatatggacacatagaagggaacaatagacaccagggctttcttgagggtggtggttgagaggagggtgagtcttgaaaagctacctgttaggtactatgcttatttcctgggtaacaaaataatctgtacaccaaacccctgtgacacacaacttacctatataacaaatgtgcatatgtacccctgaagctaaataatactaaaacaacaatcatgataaatcaaaagagagaatctacattacaatagtagaagaggacttcagcactccaactgctggcaatggacagatcatccatgcaaaatatcagcaaagaaacattggagttaaactgtactatagacaaaacaaacctaattttttaaaagaacattccaaccaactgctgcagaatacagtttcttctcatcagcacatggtaccttcttcaggatagaccatatgttaggctgcaaaacatgtctgcacaaattccaaaaaagtcaaaattgtattaaatatattttctgagcacaatagaataaaactagaaattaataacaaaatgcactttggaaaccacacaaacacattttaacatgttcctaaatgattactagatcactgacaaaattaagaagtaatcaaaaaagtcttaaattaaaatagaaacacaacagaacctcatagatacatcataattggtattaagaaggacatttatagtaataaatacatatatcaaaaagtagaaagacttcatagaaataatgatgcactttaagaaagtaggaaagcaagaacaaaccaaaatcaaaattagcagtgtaaaggaaataataaagatcagagcataaataaataaatttgaaactaaaaacataaaaaaacaatagaatgaaatttttttaagggataaacaaaattgacaaacctttagctagactaaggaaaaaagagaaaagacccaaataaataaaattagagatgaaaaaggagacattacaactcataccacagaaatacaaaggatcattagagactattatggacaactatatgccaataaattgcagaacttagaaaaaatgaataaattccaggaggcatgcaacctgccaagactgaatcatgagaaaacagaaaacctgaaaagaccaataataagaaacaagtgaaagaagtaacaagtctcccatcaaagaaaagccagtgacctcatggatttattgctgaattctactaatcatttaaagatgaattaacactaattctactcaaactatttcaaaaaagaaaagaggtgagaagacttccaaatttattctagaaggctggaattaccctgataacaaaaccagacaaagatgcacatacaaaaaaactacaggcgaatattctgaaagaacatggatgcaaacattctcaacaaaatattagcaaacagaatacaagggcacattaaaaagataactcaccatggtcaagtgggattcatcccaggggtgtaaggatggttcaacaaatgcaaatcaataaatatgaaacatcacataggcagaatcaaagatgaacgccatatgaccattttaataagagctgaaaaagcctttgataaaattcaacatctcttcatgagaaaaccctcaacaaattgagtatagaaataacataactcaacaagatgcaggatacatgtgataagcccacagctaatatcctacttaacagaggaaaattgaaagcctttatactaagatctgcaacaaaataagaatgccactttccccactttaattcaccaaagtactatatatgctcaccagagcaagtaggttcgacaaagaaataaccggcatctaaattggaaaagaagaagtcaaattgtctctgttttcagagaacatgctcttatatttacagcaacctaaaaactccatcaaaaaattctgagatgaggccgggtgtggtggctcacgcctgtaatcccagcactttgggaggccgaggtgggcggatcacctgaggtcaggagttcaagaccaacatggacaacatggggaatccttgtctctactaaataatacacaaattagtcgggcatggtggtgggcatctgtaatcccagctactttgtgaggctgaggcagggagaattgctttaaccccagaggtggaggttaaagtgagccaagattgtgccacagcactccagcctaggagacagagtgagcctctgtctcaaaaaaaaaaaaaaaaaaaaaaaaattctaagatgaaaaacaaatttagtaaagttacatgatataattaacatacgaaaacttgggtgtttccacgtggtaatatcaatgaagctataaaaacagatcaagaaatcaatctcatttacattaagtataaaaatccctagcactcaatgtaacaaacaagtgaaagacctataaaacccttaagaaagaattgaaagatgacacaaaaaaatgatatctcatgcccatcggttggaagatttacttaatattgtcacaatgtctatacttcctaaagtggtctaaagctacaatgcaatcttcatgaaaataccaatgacattctccacagaaatagaataaaaatcttaaaatttacacaaaacccccagagatgccaaatagctaaagcaatccttagcaaaaagaatgaagctggaggtatcacactatctgatttcaaattgtactgcaaagctacagtaattagaacagcctggtactgctccaaaatagacaccaatggaacagaatggagaatccagaaataaattcatacacttgcagccaattcaattttgacaaaggtgacaagaacacatattggggaaaggccagtttttaaaataaatggtgctaagactggatatccatatgcagaagaattgaactagatccctttccttcaccatatacaaaaattaactcaaaatagattaaaggcttaaatgtaagacctgaaactatgaaactgctggaagaaaacattggggaagcacaacaggacattggtctgagacaagatttttggggtaaaacctcaaaagcacaggcaacaaaaacaaaaatagacaaattggattgcacccaggtaaagagcttctgcacagaagggaagcaattagcaaagtacagagacaacttatggattgagagaaaatacttgtgagctatctatatgataagggattaataaccagaacatataaagaactcaaaaaatagccaaaaaaactaatatgattttaaaacatgataaaagatatgaatagatatttctcaaaagaagacatacaaatggccaatgggcacatgaaaaaatgcttaacatcactaataatgagggaaatcaaataaaaaccacaatgaaactttgtcttaccctagttagaattattttcaccaaaaagatgaaaaataacaaatgttagtgaagatgtagagagaatggaatatttgtacactgttggtgggaacgtgaagtagtacagccactgtggaaaatagtatggaagttccacaaaaactaaaaatacaactattatatatatccagcagtccctctgctgagtgtttttccaaaggaaaagttaatcagtatatccaagagatatctgcacacccacatttattgcagcattactcacaatagccaagatatgaaattaacctaagtattcatcagtggatgaatggataaggaaaatatggtataaatacaaaatagaatattattcaggtataataaaaaaatcctgtcatttgtagcaacatgaatggagctagatgtcctgctaaatgaaataagacaggcacagaaagacaaatactgtatggtcctactcatatgtgggaaataaaaaagtggatctcatggaggtagagagtaaaatggtggttataagaggctgggaagaaaagtggaaaggaagaataaagaaaggttggttaaggggtacaaaaatacagttagatacaacaaataagttctagtgttctagagtactgtagaaaaattattgttaatagtttattgtatgtttcaaaataactaaaagagaaaaattgtaatgtttctagcacaagaaacagataaatgcgtgagcaatggatatcccaatgacactgatttgatcattaaaggaggtatacaggtatcaaaatatcacatataccacaacaatatgtgcaccataacatatccgcaaaacaaaacagtttgacttttttctacagcaattaataagaaatgagactagagtcttattcttcttttgcttttcttacttttgatatcacataaaaagtacaaggaattttctactcaacttgaagttcctactcacctgctcacccatttcacagtatcagttggcacatattaaagtgtcatgttcaaagtattgtgctgctgctgacgtttataagtgtgagttgattggaaaaagtcataattcggcttcctctgaaaatcacctatcaagatgcaaaaatctaaagctttccctcagggaactcatctaaattccatctttgcctgtcattttttctcagttcctgtcattaaaatacatagtacctattgatcattctgccatatttttagagtgcttttgaaactggaaatctgtgaacttaattttattatttagagtattttgaaaaaggtcttcattcagctttgctacatgtacataaaagttaccttcaaaggcagaatcagccatccagtaggtaaggtaagcggattagggatcacacacttggtatgatttgagtagttctgggaagtcccatctcccccaatcaataatgcagtttgcttatgcttagaatttaattcctagagttccaaacttttgggctttgtagataagaatttgtgaacagtactcctgggagaaataacagaatatctaaaggtcatttattctttatagatacatgaaaattccttttcagagagcaaatttccagaagaaaaaagatgagaaactaaaaagatcttgagactagaaaacaggatagagaaaatggtttccgcaaggatataaagaagaaatagttctggaatattgaaatgttaccaaatttacctacttcacagatttgctttatactaacctcagaagagagccacttccgttgaagtagaccatttcctctgaagggctacattactgaacatgtttgcaatggtaaaagtgtctgctttgagagaagagtcattcttagatgttagtctctgatttaattagacagctggaagaaaagcgatctttaattaatgcttaaatttccatgctaagtgtccttaagaacagaagaagcgccctcaatgatagagtcaaggctatggctcattcacccaatggtaggaaacaaccaaccacaacttcgaatttactctacaacagcatttagcctcacaagaaaagttctccaaaaaaagtttttcttacctttgtctgactacttgcttaggatgctgtcaggctgctggaaaaataaactgagtagcttataaacaacagggatttatttctcatagttctggaggttgaaatttccaagatgtaggaactagcagattcattgttggatgatggccaactttctgattcataaatggtggcttatcgctgtgtcctcactaggtggaagggggaaacaagcaccctcttgcctcttttgtaagggcaaaggcctatctctaaataccaccactttggaggttaggatttcaacatattaatttttgggggaacccaaacattcagattataacagttaccaattctgatcatgaattactgaatggagttgacattgctctgttttttcactactaaactcagctaacttcaatcaaccatttcataacttgacgctggcaattactagatgaataaaaaaagaattaaacaacataaactaagaagtaaaatgagactgcacacctgaatttttctattagactacgactaatgagatttcaaaaaagtccttccatttttccaggtttcagttgtcctcttgagtaaaagaagagggttgctctcaatgatatctataattagggtgaggtatatcttccgaggaagaactattttgagagcagaaggaagcagtattaataactgcaccaaaaacacaggcaaaaacaaggtatgctcaggaaaactagtatgttatgattaccccacctaaaatgtacagacacctcttggaagttcttaccagtgcagtgtctaggaatttgtctcctcctcataacagtgatgagggctcagaagccgttctacacaatgttactcttatgtgtagccataattagctgcttgagtggtaaacaatggagttcttcatctggcaagctagaattggaacttaaacattatagtttccatctgcctgttaactttaaaggagaagttttaatactggaaatacgtattcagaaaccaaaaaagtcattctgaatgtgagagtagagtgaagcaggtagaacatttattgctgtcacatttacttagcacagtggtcaccataacatagacactcagcaaaactcttttaaatgaatcttctgtttcttagctgatcattaaatagtgtttgacagatctcaaaccctgttttcagcctttgatcattataagtaatccagaatggaaaacttatttccaataaagattcaaggtgactcataatattaatatatttattaaaaataaggaataaagtgctagcgaacttcttgatggtaagagagaaatgtataaggagctttgtttcaataacttgtggattctgaacattaaatattcttttatttttttacttttttgtggtgagataagggaggagagaggtgtttcatgaaaaagaaaacaattcctggagagagatttattcattagtgttgcaaaagcatcacagaacagcaggaaagacactcagcctcgggaagaaagagaacaaggacaggtgtggggacctcagcagaggagttcatagatcgtttctctagaacatggctattaacatgccttagctcagtccagtcctgtggctctttcttcaggtttttattccctggaagagataaaattgacaaaatttcattccattgcttttatttctagaccaatcagctatattgggaaaagaagaatcatttgtcatagatatggccattgaagaatttactgtgagtcaagtagccatctaaatgtatgtgccaaatacaatgttgcatctcaaatttaaaaaaaaattaaaaaaaatatgggagtgttacagccaagtaaatatgatctgataaggactccatacttctatatttgagtccttctggacaaactgtaacctaacttaataagtagacaagattgaaaacctaactaggagtgtgcacctgtaacaatagctgagccttggccaatcccagcagccgtacttcaaccactcatacactgctgagtgttcaaataaggcaaatgccaacctctaaccaaaccagctgcttctgtacctcacttccagtttctgtaggtcacttctctttttttttgtctataaatcttcttccaccacatggctgcgctggagcctctctgaatctgctgtgattttgaggctgccttattcacagatcattcattgctcaattaaactcctttaaatttaattcatttgagttttccaaggcacagaccctgagaaaagtatttgagtataagaaatttatttggaagacaatccttgaaaatgccagtagagaaaaaggaaaagaggccaatgaagaatattttatcaagcaagctactgctgtgagcaaacagaccttaatatcactaaaaggctctgagaaacaatgtagaacatacaccaactcattggtgttatcaatggagccatgcttctggggagaattcgttctcttatacttctgtcctgattgtgcagagacagagtaggtatcagcagtcaggttaaacagcttgagcaaagagagattgtgctgttggttgtgagtagtcctgtaagcaagtaaatagtaaatcactcaggagggaatattggtgcaatataatagcacagtctttgggacagtttggtactgggaaaaataaagttagatctttaacccaggtatttcgtttgaaaaaattatgtggcttaatgagtaactcataaaaaatcaagctgtgatgatcttataataaggaatatcaggttatttaacatcaaataaaatgtgattgacattttattataaataaagttaaataatttaactaataaagttaaaggcatgctatgaactaggaaatgtttgtagcttatatgatgaacaaaagcaacattatatttaaaattatgtcttttttttttttttttgaaatggagtcttgctctgttgcccaggctggagtgcagttaggtgatctcagctcactgcaacctccacctcccaggttcaagcgactctcctgcctcagcctcctgagtagctgggactacagacacgtgccaccacccctggataatttttgtatttttagtagagacggggtttcatcatattggccaggctggtcttgaactcctgaccgcgtaatccacgtgccttggcctcccaaagtgctgggattacaggcgtgaaccaccgcacccggcctaaaattatgtcttaataagaatacattgttcaccccagtggaaaaataaactgtggacaataaaactgaaatgcaaatgccaataaaattatggaaatatatttaatttttcttctaattagacagctaaacacactagtttttgcctactgaattagtaaattttagaaaatcaaatcttaaatggacctataaatcagtcgattctttctagatttactttgtaaatttcactcatcttcttttgtggtagctaaaataactattgtattaattattctgccagtttttccatttttgattctcacaaagatccttccaaagtaagcattccaactgacataaatatgcataggatgtaagtgttggctcccaaacaccatagaatttattttgtaaagttctgcttttccacattttctaaaattgcttctgcaacaggcaaatagcaaggtctctttatttgaggagataaatttgattgtggagtctttgaaaatcaaaaaaaagggaattgtttatcagtttattatcaggctatttatctgtttgtcatcccactccatgaaaaggagaagttatataatgaaaatcatgtgcagaaaaaaaattgtattttggcagatttgggaagattatttggcatggaaagaaccagaaatagcaaggtaacctgggaatgtgacttagaatgatgaaagtgagaattgagggtgataatggtcagagaggaaaagatgtttacaaacaatatatattttatatatcgtatatataaatatattaatatgtatttttattatcaattttattattttattatcagttggtttccctggtatatcctacatcttcaggcaatatatatatatatgtatatgagttgagtgttcaaactgtgttcaaataaagcaaatgccaacctataaccaaaccagctgtttctgtacctcacttccaatttctgtgtatatacatacaggttaaacaaggaaaatcagttgataataaaatgcctataattaagctacatttagaatatgtcagtaaatttatatatatatatgtatatgagttgagtgctcaaactgtgttcaaataaagcaaatgccaacctataaccaaaccagctgtttctgtacctcacttccaatttctgtgtatatacatacaggttaaacaaggaaaatcagttgataataaaatgcctataattaagctacatttagaatatgtcagtaaattgacaacattaatgaggatatgcattattctggaatgaacatgttcctccccaaatagtttcaaaagaatggaaagcatagctttccataataatggaaagcttcattccataataatgaagatgaaagcttgtaaaacatatgacattgaaaatgcattttaacattcattgcgcagtcattaactttctctctatacctctttaaactgtgtttcaatccagtagtgtgaaagcttgaaattgttgcttgatattccagaacatctggaagctttggatgaaacaaacttcagaaacaaacttttttttccttttatatatagagaattttctcagaacgtaggtttaaaattgtaaggatagattggcttgccttctatattccttccacatatgaaaaggctgatataagtatttctaaaatataatttgccaagaaaccctgaataaagccgaaaatactaaaagtagaaaaagtttacttaagggatactttttaaagattttttattaaatgtgcaatgtctaaattgtaatttttatagtaatctagtttttagtgtattttagtgtattcaactctgctgaagtatacatatttattgggaaattatggttataatgcaaaataagaatgaatattaatgtaactttacatggccttaaaattattcataataatgaagatgaaagcttgtaaaacatatgacattgaaaatgcattttaacattcattgtgcagtcattaactttctctctatacctctttaaactgtgtttcaatccagaagtgtgaaagcttgaaattgttgcttgatattccagaacatctgtattttttaagcaggactctaatttccatcacctaagaggcagacaggatatatcagcaatgcaggaaggacagaaacaaggaagaggaaggggctccacagaataacacaacagtgcgaggcactgagtatatatatgttgctctgaaaaattgaatggttaacaataagataataaataatatattcattaatatatttagttatgaagaaaatacacggttttacttatatgtgacacaattggcatagtaatcaagttattgtccattcaacttacagtttacttcaaactaaagactaatttccaaagcagaaaggatattttgtcaaatggtgaccttgtgactaactcatgtgtattctattcttataaacactttttctctatgtgaagaaaagtgacaattgttttttcaatctctattaatttatttttcaaaattcattacttgtacaatttattttccaagctaattctttgttttaatttttttattatactttaagttttagggtacatgtgcacaatgtgcaggtttgttacatatgtatatatgtgccatgtttgtgtgctgcacccattaactcatcatttaacattaggtatatctcctaatgctatccttccccgctccccccatcccacaacaggccccggtgtatgatgttccccttcctgtgtccatgtattctcattgttctattcccacctatgagtgagaacatgcggtgtttggttttttgtccttgtgatagtttgctgagaatgatggtttccagcttcatccatgtccctacaaaggacatgaactcatctgtttttatggatgcatagtattccatggtgtatatgtgccacattttcttgatccagtctatcactgttggacatttgggttggttccaagtctttgctactgtgaatagtgccgcaataaacatacgtgtgcatgtgtctttatagcagcatgatttataatcctttgggtatgtaccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccactctaactggtgtgagatgatatctcattgtggttttgatttgcatttctctgatggccagtgatgatgagcatttttttatgtgttttttggctgcataaatgtcttcttttgagaagtgtctgttcatatccttctcccactttttgatggggttgtttatttttttcttgtaaatttgtttgagttcattgtagattctggatattagccctttgtcagatgagtagattgcaaaaattttctcccattctgtaggttgcctgttcactctgatggtagtttcttttgctgtgcagaagctcttcagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaaataatttttgtataaggtgtaagggagggatccagtttcagctttctacatgtggctagccagttttcccagcaccatttattaaatagggaatcctttccccatttcttttttttgtcaagtttgtcaaagatcggatagttttagatgtgtggcattatttctgagggctctgttctgttccattggtctatatctctgttttggtaccagtaccatgctgttttggttactgtaccttatagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatttataaattaccttgggcagtatggccattttcacaatattgattcttcctatccatgaacatggaatattctttcattcgtttgtatgctcctttatttcattgagcaatggtttgtgtgacagttttttagctggctcacttcactccctttgaaggcagcaagtgtagagctgacatgggtggtgtgtcaaaggtgcataatctgcctaggggagtcaggctggaacagtcaacccatctgagatggttgtttttaagaagatatcaatgaatgcaaagtgtttttgttttgttttgtgggctttttcatatattcaagccaattctgtttctggtctcctctgtgtttggagccatggttgtttttgttaggagtggccatttagctctggacataaatatccatttgttgagctcagtttggtgtcagcctttcctttgcttactgattaaatttttatttggttaggccttggtgtagtcctgatgtggttgtcaggtggtccctgtatgtcagctcaatctttgttcagagcgattcttttaaaatcaccccaagcaaggaatctaaatgaagtcctgctcaatccaaatgtgtgaaactaagtagatagagaaataggtagatacaggtagagagaaatagttagatacaggtagagataaataggcagatggatgaaattcagcaactgaaggtggtaaaatatgagtatacttgtatatctgataaatagaaagtaaggaaaaaaattacttgtcagttgtctttgtaacaagtattttattaaattaggtagttcctctaattttgttactactgtttgttttctttgttgactgaagatctgtaattgccaagtgcctgtggctcaaccataagcatcccaagcacatattaaaaagtctaccgataatatctcccacactaacaatgtattttaatgtcatttattaagaggttagtatttacatataaacttacatacaagttctttcagtgttaagaaaatcagagtaggtaatttactaaatcttttgttctacttttatgttgtctaggtgagttcatgtgtctagggtagttatttgtgtgagtagccagctttgagtgaggagggaaggctgactagatatcagacattatataatatttggggttaacaaactctttgggaaattatttaaatccatttttattctgtaggtattagctacagtgaatgagtaatttttgttcatttgttctttatttttacttttctcttgttagaaaggggagttggacaaaatggaaattttggaatgaaggctgaatctgattatcttagacattggaaagtctttgaagataagaaagggaaagaattacactgttggttgggggtgtaaatttgttcaaccattatggaaaacagtatggcaattcctcaaagatgtaaaaaccattcgacccagcaatcccaatactgagtatatacccaaaggaatagaaatccttcatgcatcattctatcataaagatgcatgcatgtgtatgttcattgcagcactgctcacaatagcgaagacatggaatcaacctaaatgtccatcaatggtagactggataaagaaaatgtggttcatattaaccatggaatactatgcagccataaaaaagaatgagatcttgtcttttgtgggaacatggatggagctggaggccatgatccttagcaaactaatgcaggaacagaaaaccaaatactgcatgttttcccttataagtggaagccaaataataacttatgaacacaaagaaggaaacaacagacactgaggtctactcaatgggggagggtgggaggagggagaggggaataaaaaatgacctgggtgaagaaatgatttgtacaacaaaaccctgtggcatgagcttacctatataacaaatctatacatataccccttaacttaaaataaaagttaacaaaataagaaaggaaaggaattggaggatactgaaaaaggactttgcctaaattgggctatgatgctgaagtggaaaaaagaaaactgtgtacataattttgaattcttggagttaaaatatctgtacttctatgatggcaatgctctatcaattttggctcatattattcttttattcccagttgtgtttagtgcctacggtttctgtcttatgttcctttcccctttatgcctctctattgtcaccttcatcctcgctcacctccttcacaatctctctcctctctctctctctctctctcacacacacacacacacacacacagaagaaaaggtgatgatgaagagaaatggctctctctctctctctcacagacacacagcagaaaaggtgatgatgaagagaaatgaggagacagatttagaacaaagagctattttttaaaatgtagttcacttcctagcaaagtgctgggtaaagcaatatttatagttatcttatgctttgtataattttcactttttcgttctttctcattaaatttgttttttttcttgcaaacaggcatatctgtactctctccctcatatatatcgatggcttcctatatacatataaccacaatagatacggtcttctctttttaccttaaattttttgcttccttcttcctttcttctctttttttaccatccaatagtcaaaacaatatgcatatccagatatcttgacaggaggctttttttttctaacctaggcaaataattattctttggttgttacataaatcacttcaattaagagattgcccttgacctatgtgaaatattttcaaatgatcatatttctaatagtttggggaggggctaaggaggatattgcagaggccagccaaaaacttgggaccatagctacagagtcagctagtaagctaatggataagattgacttaaaaagagcgtgagaaaaactggtctacattgacctatagtactggatcaggagtccagttttttctttcttttttgtttttggaaatcacattgtatataatagctaatggctcataaatatttaatatatttgaagttaatatcagtccttaaaatttctagtgaagttggaaaagttattgttggttttacctgtgattgtttttgctttttgagaagaaacttcatagtaataaattatgactctttcagagctataaattgaaacattttatagattaaaaatttgctaaagggctttttatccacataaaatttatgagtatattaatattctactgaaaaattgctgagaagacaaattcataattataaatgacttaatttaataaaaatgttgattcaagtaattatttacttaaagcttaagtttgccgaagagcttctagccaattttttattaacgtcacataataaagtaattgtggtacttttaattacgttctcagagtagctacgttatactaatatgatttttctttcttctaggcttttgaaaaaaaactggcttacctaagctcttcattcaggatgtcagagtgtgaggcatttagaaatacaagatatttgtctattaatgctcaagttagaaacagttagttacgttttcaaggtactggagaagtacaggggaggggaattaagatatatctcttcagtactaaataatttctggatgatacatttctcaaagaataagatttacctcttgattgagaattctctggtgagaaccaggacagctaatgacttggaaatataatcattagattgaaaatagggagttagtaaaaaatatttttaaaccattaaatatcacatgttcatatgaccttaatggatgtttccaataatttaaatttacagagtattaccgaaaattctttcctttgacatgatgagatttgtattcaagctttaaagaataatgaaatatatccattctctaactatatttccatccttagaaactcataaaacacaccacggtgaaaacctaactagattcgacccaggaaactaatcttcctaaacctcctaagttttctccaaatcaccatcaaagagtaaagttacaatgtgccttatgaaaagtggtgattttaaaagcccttgagattaagaaatctttgtttaaacaaaaatgcataaagaaagtaaatatgaaaaccagaataatattgagctgtcctccttagatctggccctcccgctctgaatttttctctctccacacatgtaaggaactctaaaggagcatgtggaacaaagtttgtgtaaaacactggcctacaggactgttaagaaattatgtagaaattttgccattataaaaggcattattaattttcctcttagaaaagaatccatgaacaacagccctctcggattttcctctcccctcttctctcactgctcacctttgtcatttatacgagcataatgtaaagtaaaacaaatggcaccctaggtaaatcagttttcttatttatgctttgttaatatttctaaaattctcttagaacataaaacaattcataccgcacaagaatattgcaaaggctagataaattaatatttgagtgaatgcttttacagtcattttaataaaagagtattatttttgtgattataattgcatagttgggccagaacccaggcttctacctcttgatttactgcactttctcctagagcaggctgctgagaattccaccagcttatttaacagtgtccatggaatatgtgaaaagactaaatccagttctgggagcaaatacagcaatgtctggaagcactgacacaatcaccatcttgagaattggaaacaaatggcagcattcttttctatttacttatgttcttgtatattccatcatttccaggaagccttataacccaaggattctcatatggctttatttttgttagttatgttgtaatgccatgccagagttttaaatttaaattctgtagccaaccaccaaatttgaaaaaaagctattttaaaaacaccatttgggcttctccaacactgcagaggcagcttgacagcagttagtcgtgctcacctttccttttttcctttgttctcctcagagagctgcattggactgacacttctgactcactttcctggaactgtttgaaaggcatcacataaaatttcaaggaaagcgtttaaacttgtagaaaactaaaatgagtttaaatatagttcttaaacattgctcttaatagttgaagaattaatggtatatatatgtgatagaatgccactcagaaattaaataggatgttagagtttagaacgtatcaactagaaaagataatcaagaagaacttccaattgaaaaacagtttttttaacattatgtatgcatgcatgtatctatctacctatctgcctatcgatctgtcatctatttatctatctaatttatttcagtctcaaataacaaaaaataatatcccagcaggtaggataattttttaattttcttttttcttggaatttttatttctttgcctcttcctgctttcttcccccttcctttcttcttgtcttttttccttccttcttccccttccttccttttttcctttattccttccatttttctctttcttcttttatgatgacctttaccactatacattttctgcaatgaattgatgtcccatgtatagtaaagcagtataacatttaaatagaaaaataatattttaaacttgttcataaggcaacatcagtgaaatatggattaaccagactgctcttacatagccattgattgtttgctagtctcattggcctttatatttcttcttcatttatgaaagagatggtgcttcagagattaatcagtattaacagctgtatgacgggttatttacttgcctgacacttttactaattcttaggcctgataatagcttttctcccttatgacacagaacaatttctaaatgattgacactaaatgttattacagtattagtggactcagaattaattttaatcaaatgtcaaagcaagggctttaagtaggaatcgagaacaatgcttaaatattgaaccatattttttgtaatataacaaactagtaacttaaattttattgtattttgattattgtgttcagttatattttccacagagcaagagataaattaagctcattgcatttcaaaaagtagttcacaagattgctaactataaatgtttaaggacatcaaataactgcaaatataaaatgaatggataatttcagaaagtttctaacactacccttcctgtccctcccctccttctctgttgttttataataatcatcagaacaggatttgtctatgcttaagaagtatatttctacaattttaagtttattttcacttttgacatgtgtattaaaactcaggcacatatttttcatgcttattatgttataaatatacacttctcttacaagttaattttttaatggaaatacaatatttatttgatttgtgagagacgaagtctcgctcttgtcccccaggctggtgtgcaatggtgtgatcactgctcactgcaacctctgcctcccaggttaaagtgattctcctgcctcagcctcccgagtagctgggattacaggtacctgccaccacgcctggctaatttttgtatttttagtagagacggggtttcgccatgttggccaggctggtatagatttctggacctcatgatccgctggcctcggcctcctaaagtgctgggattacagccatgagccaccgtgccaggcctgtcatattattttctttagattttacagaaggtacatataactttttttttaaatacagaagtcagagttttctgtcttctgtaaaaaaatcattatactataatcaatggatttagtaagaaacaacagaacaacacaatttcaccttgtatagctaataatagatagtgctatttgtaaaaagtaagtcactataggaaagcctggagtctcctagaatcctaaaaatatttaaaggaaataacaaaggcttctctttattttaatgtttttttatctaaaactctttatttcctatatttagcttatagcacagtaagggaaatttaaatatatttttagtatttaaaaggaagtacaaatgttaaatatcaatttattgtatttaaataatttctatgtggaaatcaagtgagtaatgaaatgtaatattaaagtttcagcattcaattttaatctttagttctttcatcagactataggaacacaacaggcaacatatgcaatgtttccaaatttagaaaaagcaaatttgcttaagcaacaattttaagattgtttactttagataatcaaattttaatcagaaaaattccaactcaaacttaagtaaactcagtatttttaagattatttactttagataatcaaattttaatcagaaaaaatccaactcaaacttaatgccctatgaagtccttacaaaaaaaaatgaatttttatgtaaaatattttttcttaaaatgagcttttaattaggttaaaataagtttgttttctgcagatatgtttctatagtactataactttgggttattttaatgttaactagactaaagatttgaattatttgctttaagttctgtgcaaatatgacaaatcgcactttaggatgttacgataatgccaataaagtagacgaaagggttgtttaaatcctgcaagtgagttaaaagctaaggagaagtcaaactataccaaagcctaatatgtccaagttgaggtgtgctggactcatttcattgaactcagttgcactattcagaatggtaacaccaagaagagtagcccatgcctgctgtttagggactgaaaattgttactttcctttttaaaaacaatttctatgactctcaaaatacattactgacagttccttcttctggttgagaaacatagagcttgacaattaaatatttcacttacttttagtaagttcatttacatggcataaaaagattaggtgtaaataaaacaaaaagacagaatcaagctctgcctaatcatacacaagttaagtgcacacaaattaaaatatctgaaatacaaagtgaataactcaatgctatcaacttcccaacttgctttcaaagtaccttgattcacttttaaatcaattattgtaattataaatatgttatcttgtctttcttgttttagagctgaattgcaacatattatttccatgtgatccttagtgcttagcacacttgcacaaatagggaaatttcaatacaggcttatttagttaaggtgattaatggcatattcagtcaagagctttttaaaatgaattttgagtggtacaactccagtggagtactggctgaatttcagtgggctgtgttggttgtttgcaatgacacagagagacacatacagagagagagagaaacagagaaggagacagacacagagaaagagggagaaagaatatgtgcaggatttcctttgttttttctatatcaattttaagattctccaggcaaataagaactttgttcataaacttaaaaaaaagagcaaatttatttttattactttgtatttaatgacttgctgagtattgcatagtaattattgagaaatattgtgctttttctaatagaacttgagcaatcacgggttagagtttgtgtatattttctatgcgttgaaacaatattaaattatacctgataatatttttaagccttgccttgagagccatctgcaacacctgaatgacaggcctcggctttacactctctaaattctattgcatgagactatgttaaagctgacatgttttttaggaaataactttttttctctggagaataggtgtcaagtatgtcatctatggctggctaatttaccacttcactgatcttattagctaagttaattaacatttttaagcgtatccttcatagtactggtaatcattagaaatgattttttaaaggtatacacaaactcaagacttaccaataacaaaatacacagactgagacataagttttcaaatcagagcctttaaattaatttgagatgaacttgaatattttcaaaaacattgcattatagttatcccttcatagacattaaggtaagtaagctaaattgatactccagggtacagaaaaaaatcagggcacacttaatcagagaacaaactttgtgaagaaattacctaacccaaaatgcttcctcagatctagaaaataaaagcttgagatttaggagaatactggtgggggatggggggaggaaagaggagaacattaaactactgtaggtaagaaaatatcaggaaaggagtgtaggacctacaataaggacaaaggaacagaaagttattgagaaaacaagacaaggtttgatctttcaaaggaaagaaatgaaatactgcaggcagtttacttggctttgctcactctcactttattcttctaaaactggaataatatctaatttccaagaaatgttttgaatattaacagaaatgttcataaagcatctataatattactccacacacagtaactgttgactgtatctagctcacaaaagcgcatattagtaataatgagacaagccttgtgtttgcaacatttgtaatcaaaatgacaacaaaattatatttcataaaaacagaatcttgaaaattttctactttagttgatccaaaactcaatgaaagcctaaattccttttacattattaagaattaataatcttaagataaagaaattttaaaactggagatgtctacacagggattttacacattaagcacttttccaggttgtaatatcaatcctctccaatgtcttaaatacttcatacaaatctatctactatgtatggattttggctggtatgtttttaatttttttttattttttatttttttgagattgaaagaattcaacatgcagtgacatagtagaaaaataaggcagtagagttgaaatggtaagacgatctatgggcagacttcttatctgtgaaagaaagaacaaattaccttaaaaatatactactgatattacttatgtaagtgattactccttgtgatggttaatattaagtgttaacttgcttggattgaaggatgcaaagtattgtttctgggtgtatctggatgtttctgggtgttgccagaagagattaacatttgagtccatggactggaagaggaacacccaccatcaggaaggccaacccacaatatgggtgggcagcattcaataggctgctagcttggctagacaaagcaggcagaagaaggtgaaatgagctgacttgctgagtctcccggctttcatctttctctggtggcagaggcttcctgccctagaaaatcagactccaagttcttcagatttttgactcttggacttacatcagtgatttgccaggggctctcaggccttcggccacagactgaaggctgcactgttggttttctaacttttgaggttgtgggactgagctactactactggcttccttgctcctcaacttacagatggccaattgtgggacttcacctcatgatcatgtgagtcaattctccttaataaactccctttcatatatatatatacctcctattagctctgttcctctagaaaaccttgactaatacaatcctcttcttggccctatcaataattctcagaattttcacctggatgtaccttgatgcaaatggtttacacatctatccttggccttcaccttttacggtcttcagacacatctcagttcttttgctttaatagtcctctgaagcctggataatcttgcccaggccctctttaaaggaccaccaaaatagatatctgaattttgcaattttagattctaatcttcctaactcaccttcttctcttctctttctttacagttgattatctttccctctcctgtcccatcctactagctcctgcccaaatagaaaccaagactttactttctgtttatactctcacttatacaatctaaaacatggatttgatattttctgatttccaattctggcatgattcatgattaataatcaaatctttctccctctggacaagaatgaaaattatttgggtaagactactgtcttgactaaatcctgagacttccacccaatcatacagtatccatatatatacagctcatatatatctatcttgctgagatttggacagttgtttaaatgtaattgcatctatctgcaagtatttacttctcaatttataattctctgcattatgaggagtctagataagctctattgggaacttcactcagtaggcctattttaggagtcacatctctgaaacaaaacctaggacaaggaatcttatctgaattccaaaatggaattccaaaataggaaaccaaaaatggagaaatgtgtagagtagtcccccttcatccccagagatacgttccaggactccaagtggatgcctgaaatcacagatagtactgaacactgtatataccatcatttttattctatatatacagctacctacaagaaagcttaatttaataaattagacacagtaagagattaataacaaaaactaacactaaaaatagaacagttaatatactaaataagagttacatgaatgcatgcatgctctctctctctgactctcagaatatctaattgtactgcatgcaccctccttcttgtgatctgttgatctgataatcgagacggctactgagtaactagtgtgggggtatcatattcagcatggatatactagacaatggaatgattcatatcccaggtgggatggtgcaggatggcacaatattttaccatgttcctcagaagtatgaaatttaaaatgtgtgagttgtttgtttctgagtaccatgcagtcttgattactgtaactttatagtaagtcttgaagtccaatagtgtcagttctcaaactttgttcttctttaatattgagttggctattcggggtcttttgcctctctatataaactttaagtatcagttttttcaattccacacacaaaaaataaacttactgggatttctattgggatttcattgaatctgtacatcaagttgggaaaaattgacatctagacaatattgaagcatcctatttattagtgtggaatatctctgcatttacttagttcttctttggtttcttttatcaaagttttatagtttttttcatatggatcttgtacataattttgttagatttatccataagtattttattatgggggagtgctaatataaatgatattttttattttcaaattctattagttcattgttcatgtataagaaaactattggtttttgtatatcaactttgtatcctacaaccttgctatcattgttaattagttccaggatttttttgtcagttcttttggattaactacatagattatcaacatagattatcatgtcctctgcaaataaatactggttatttcttctttcccaatttgtgtatcttttattttattttaaaattgttgttgttttattgtattagacatttccagtatgatactgagaaggtgacagtagcatccttgccttgtttctgatcttagtgggaactcttgagtttcttaccattagtataccagctaggtatactagctgtaggctttttgtagatattctttatcaagttcaggacatttccccttattcctagtttactaaaagttttttttttttaatcatgaatggacgttggattttgtcaaatactttttctacatgtattgaactcatcattatttatcttcctaagcctgttgacatgatgaattatcttagttgattttaaacattgaaccagtcctgcatatctgggataaatctcacttggttgtggtgcataattatttttatacttgttggatttaattttttaatattttgtgggggattttacatctatattcatgagagatattaatctgtacttttcttgcaatatcttcatctggttttggtattagagtcatgctggcctcacagaatgaattagaaagtattacctttgcttctatcttttagaagagattgtatagaaccagtacaatttcttccttaaaagttcacttttagaattcaccagtgaacccttctgtgcctggtgctttctcttttggaaggttattaattattgattcaatttctttaaaggatctaaaaaagtatgtagtggcaatattataaacaaattagaaatatgggtttttatgtttatacaaccatggaccattctcaatgattaggcagaaatgaagtttaagttatactttgagatgcagacttacattatattgtggaatttcattgaggttctgtcactatgttgtttcagcacttaaagcaacttctgaataatttaatgaatttcattaaacaatgtgataggttactgtatcttctgtacatttgaagagtgatatttagctcccatattttgattattgcttatttatgtctttttccagccagagtatgagatgtacacttaaaacatttcattttaaaggtagcatgaagactttctctaagctcaactgttgtattcttccgactggagattttgttggttcatgtaatgttagaatagtcatggtaaacttccttaagtgcttaagtgtaaagtgcttatttctcatataaccttagcagttacaacaacctatgttttagaaagttatggttcagtgagggaaaaatgtgcagtgtaatcatgaaaataaggaaaaaacatagctatgtactaaattcttaattactacctaaagttgagatttacagttcaagaagaggcctatatatcttaataaattcaacagtgacacatgagaataatgtaagaaaacaacttgggtttctgagggtaggggataaaaatatcatttaagaaaatgtaaaatttgcaaattctgttattaagaatgatctcaaaatgatctgaaaatatataaatataggatgaagtgagacattattttaaatatatccctctattattttgcttctatttctcaggaaagacaacgctaagcattataaagaaaatgaattaaactttagacataattccaatctattctgggcattacttggaagtaaaacaacttaccacttttatattttatacatgagattgtttttatttgatacaaaatgatataaaaataatcaaaagatcataacctggtagaattgaaaaaaaaattgcagattatttagtcattatattgtagcccaatgccacattttgtattaatttagtgaaaaggacgacaaaaccaaataagaatgtagtagataaattccttttacttttagatggaaaatcaactaattcactaataaacttgttttgtattttttacttttcacattttctttcagaattggaatataaagaagacgtaataaaatactttaaaaattataaactgttaaattgtttgatctaaattgccagactaaattctgctgtaatctaaacttcattttttcccctaatgatgtctgtccctgtaaaactaactagagggaactagcaaataattcccaaatactctggagggcattaaagtagtcactttctcctttagaaaaatgaatccccaaggcaaatgaatcattcttcccacctccttagtcagcctccagtgtacttacctctttcctaggcctcaagtttgcccagttatctgtgccactgattttgcttggccagtttttatttttattttgttgggactatttgaatttctgcctctctgagctatcagaaagcctgaaaattgaagctattctcaaataatgttgaaaaaaatctggaactatgattctggaagtctctcagtcaatgtaactataaagctacagattagttttttaaaaaaagaaaaacaacaacaacaaaatctattgagttaaatttctttctgattgaagacatgcatttttttatttaaaaaataggaaaattttaaagctaaagttgaaaataatacagggctttttagtcatagtcattttttattattatgtctgtggctgattagcacagtgggtctaaattaatggccagaaaaatggtcacagaatgcctcaaagctcatagctgatgttggcctaatattgaccttacgatgttcacttatcattatgtatgaagaaatcacatagaagcaattacatttgataagcacttgttttctatcattttctttgtgaatgcataaaattgtgaatacatacacatagtgaatttgaaacaatgatgacaagattacatcttttagttttctttgtcgacatttagctgatgaacagtataggaaaaagtatccagaaggtttttaaagctatggctagtccagttcagggcaaatcaaaagtaccactaaatgacaaatattttctttcgatttaatccttgtgaaataagtcaactaaattatgcaattgtggtttcacatcatccttccccaaagaagttttctcattgctgaacaaggaaacattaatggatgaggaattttcagaccaatttagttgtttgtgtatatacatatatatatatatgtgtgtatatatatatatatatatatatgtatatacacacatgcatatatatacatatatatacatatatgcataccaggctttaaaacatgctactttgtatttctatttttttcaacatttcctatacacatatagctatagaaaattcatgtatattaaaatgagtatccgtgtttcttaaatgatttttgaaagaattgtaatcactataaagagaatgtccctgaatctctttatagaattgctcttacataatgcacttccaagccctccaaaatggttctactcccatacacagatgtttttctttcttaaagtaggaaaacatacatagcataaaatgcacacaggcttattttaaaataatttcaggattaaatttctgaattaagctttatttttagcttgtcacaaattccaaacagcacatgcttttacagattttttaatgcttctatcaacaaacatgataaattatatttttatcattccatagagaaagtggatctttatctatctgactcagcgttcttagcttcaaggtagacatttgatttgttggctttcactggatggtaatagtagactattttagaagacagcctcaaatgtatcctgacaattatgaattctgcctgcaaacttttgttcatttttccttagatttggacctcaggtcctctccttgatctgaaacatcttgtacctccattgctacatgccacgtacctctcttaggaagataattctctcaccctccgacttcaagactttgtctatcttttgctgccactattaactctctgtttttcctcattgcctttctaaaacttcttttttttattattgaattacttttaaaaacgcctctcttgcctcctttccaagcatccacacaaaagttctgtaggttccaaaaacattgccatcttcttcctaagtgtcttttaatccacattgatgacatacattcctgtgttgtgctctctttaatgccacaattaagtataatcgatttaatgcaaactttacctcccgtgataaagataagtcaaatttatagtatcattctaattctctgtattccaagattatacaggtttctgtagctgtaacaccagtcactttccactgaaatttcaacatgtggaggctctaaggtcctttagggtcttaaatcttcatgaggatagaaacctggaggtttttttgtttgttttctgctatatcatcattgctcaccagatttctactcttagtaatagttcaacaaataccttataaaagaatgactgagtgtttttatttctagggtctcagctgcatgggtggtctccatagctggagagcagaacaagcctctgtgtgtgagcattccttggctccctaagctacattgccatctactgctcacacttgtggcctttcatggtggcaaacagatgaagctccctctctctctctctttctctctgtgtgtgtttgtatatgtgtgtgtgtatgtggggagggggagagagagagagagagagagagagagagagagagagagactgacctcgttggcttttatctacacattttatgcacttctctgtctttatgcttttgttttatttagtttttgtctgacgagagtccctccagcccccactaccatcccacagatttctttctcaggactttgttctccaatggtcatattgtgaaaatataaattttactgtgttcttttaacacaagtctttaatccatacaggtggagtgaaacactgtttagaaatttgaaagtaaaactgccaactaaaaattaaatattattactattttaatttctcacatttgaatccatcttttcttcaaatgaaggtgttttaaatttttaattttagtgccactgttctgtcagaaagagaaaagataaaatcacgtatgtgcttttttcaaaatcccaattttcttttaagtcaaagtctaagtgaacgtaacctgattttctttcctaataattagttaactaatatttagttgttatattgtattctctcctttatttgccctatctgtggtcttttcagattctcacaactatttgtgtgataatgtcccctttgatgctcatgtcatacagagatgtcttccattctgttctcgttttttttaagagtcatccagtctaagacagtcactagaaaaaatatttctctgaaagagactttatttgaaacaggtatcaagttgactaaataaatgcttaaatattaaattttcagtatattctgtttagaggacgtatgtataggtgtggctttccttattttaaaaacactgcttagaaagaggacaatgcaatcaatatttgttatacactataattttgatggcatataaatacctattttagaaagaaaatgagtaatgaataatcttcatattggaatttcattcaaaaggtgaaaatttgtttcatatcgatgattctacaatgagtatatttaagtgcaattgttctgctattaatttgtttacttttaaaacaatgtttcttgtagatgttggcaaaagacagaagatttggaaagaacacaccgatttatatataacaaaacaatttaaaatatattttgagctgtcttatgtacagttttagtcacatattagatctgggttactaccaaaaacaaaaccacacaaaataacaagaagctatactctattctgaaaatagatcataggctaagggaatctgtctctgataaattctgtgttgtaatattactttcagggttccaaagagtaagtggactctaaaacatgtatgagataatgatccccctcagctaatgttccatagcattgttaaatatatatatgtgtgtgtgtgtgtgtgtgtgtgtgcgcgcgcgcgtgcgcgcgcatatgtatctatgtacctgtctgtattatattaacttataatcacatcacttaaaccagtaaactttggctacccactagaatcacttttcaaaatacaaattttgggtctcatcttggaataattgaatctaaatcactaaatgtgggatccaggcatcggtatcttaaaaattctccatgatgatgctgatgtagagccagagtcaaggacccgtgaacaaataagtagagaaacaacccagcacattatgaagtatgttagttactagttttctgaggctgcaggatggcaatcattatacaatgtgaataaactacagaagaaagggcatatgagtaattttcagccctagaattggttctcttattgttcatcgcatatgcacccctcataaaaagtaccataaatacattccttcaacaagtgcaacaaaggaagcaaattcagaaatcattctcttgttacttccaatatgtgcgtataccttaggcaaatgtctaggtctccatggtgggttctaacatgactatcctgtggcttcaccccatggggagacaaaaattttgtttgcagagagagtttatttttacagcaaatcagagaagaggtttccctccatatgaatccagaatctaaaccttaggtggacaacagaggtctaccttgaatagccatgaagaagttgtcttaaataggaatgttaatgcagaatgtagtccctcattaatacaggttaatacaaagattccttgtataactaaaggactaaagatccttttacgcaccttcttctttatatagctacttatttccgaataagtctgggaaataatcagttatattctcaaccaccattccctaacctctgcaagaccagagggtggaacagacaatggaattaatgtatcctggactgtaaaaatgtgagaagaggtaattcgaaaggtaaaacagtctcatatttaagcagattctccttctttagcttactgtgaacagttttactcccatgatcagagcatggatgtggaaagatcaaaagtgaattttaatgagaaagtttaattcaaaggtttgaaattacttgtttcatgaaattacatgaaatgggggaatccataactagagaagacagagaattttcttttaaaaatattttatgatgtattaatgattattttctttttacattaggctatgttgtactgtttttataatatatacattttttatttttccataaatgtatgccttcctatgatatatctgaaaagaaatgtttaattgaatgctaacttttggtcagggctctacacaataactgtcagctttgagataactatgtgtaaggatcttacttcaagttagaagataggggcccttcaaaattattaagattttcagttttgattttagcaaaaaagaatgagcagatcagtttattcaaactagatccataatatcacacatatgctttcttctagattaatttatcatttcagttcagcactacctgccttatatataactcagctcacttttaaggagaaatgatactacaattagttttggatgacctttatattttcaccaaaaatgtattagacatccctgacatgccccttttgaatcagttcctatttgtgaatgacattgtttgcagatatgggctgtaacattacagaaactgaaaatagagggaaaaacttctgccttcatggagtttaccttcagtaggtgattatcatcttgaagccatagtagggtaaaagagttctaacattttccttgatgatgacagcttcaaaacaaaatgttcatttttgcctaaaaatatttaatatttgtttgagtaaattttttttattaaattgtttgtaaaatgccgtctcttttaatttgctatcagagttatagtcaatgtaaaacagtaattattagagatgtatgacttaggtcagataagtttaggttacaattttgactaaagcccatcacaaaactctataaagtaggtagactgcattctcagaggtgaaacatttatgagggataaagaagagcagaattagatgacttggtgagtacatgagtacataaattggttacactggcatagagagtggatcagtttcaaagtttatatttagggcacttgtcttaaatttaaataattttttttggcagcttttgcttttagatacagtaaaaaatgtaaaaagctaatgttaaaccctaagatgaatagcttccaaaggagataagctattgaaattagaattgatttaaaaaatagcttgaccaatagcagatttagcattagaatgaagaactatttacagttttacaaatttcggttgattatttaggttttgtagggattattttctaataaaatatccaataatatattactattaatctaataatagattatattctaataatagttaatagatattatctatatctattatttatctgcttatgacatttattctgaagctaaatgtgtttgttattctgaagacaaacattacaataattataggagtagaggagataagacaggatatatttccaattttcatattatgtcaaatggttgacatataataaaaatcatgctgaatttgctaataaaattagtgataatgtgagtatatttagatattagcaactcagaaaaggagatacttttaaagtaaatatacctctaggactttctctttctacttaattattgggacttttctatagtactttccttaaacactaataatattttgtgattcagatgatccctaggtttcttggacatataaggtatgtacattcttgctaggagtaccaactgttttgttcagtattaattcaggaacatatacatatgtctaagtaatttttgtataaatcatatgtacatatgaacttattttttattctttattgaggatatggaagcaaaaccatttttggcgtacaatctgatgctcagtaggaaacttccccacattggaaaaaattttccttcagcacgcacctgtgtgtgaccaaaggaacaactacaattactccatctttaaaatccagtgtcttaatcatttacaaaacatgaatgctcctgacctattgtaatttcctgtagggaaaaactaagattatacatgtgtatatatacatatattttttcctcagttttaagtcatctcctgatgtattcattatttggaaaaatattatttaagattattcactataacagagacagaagttgacatcaaatccttatgatggagctataatttattatatgagttcagaaagttcctaagaaaaaattcctcctgatatttgaagatctacacagtaaaggatcatccaaataagaagcaacagtataaatgaaggctgtatttacaagggctctgggctactttgcaaaagtcacattaataatttgtaccttgttttctgtcccttttcatttacatatcacgttaaaaatgaccatttttcccgcttttaatttatagattagaatttggatatatttgtaggtattgcatttcaaataaaaatccactcataaagtcttaaatgtgtactatatatgcataacctgatttatttcttaacaaatgtgtttctaatgctattcttgtaactaaaaacctaatatattattactatatgatttatactgctgattttaatgtattttatagactatataatatcaatctagttctggtgataatctgttatttttatgacatatttactaaagtaatgtagaagttatttattaaacataatagaaatacttttgagaacataattataattaaacctcacaacaaactgctaggggggttaatccttatttttcagataaaaacaactgagacttagaattagttaaataatctttccaaggttacatacacaaagggcaagagttagatttaaatccaagtttccttgacttttaaaattgatgactttcaatgctatagcatatggctctgtactgtgttgtatataggatacaaagaaatatgacaattgtgtgttttcagggagcacaaaatacagttgagaatttaattattgaaaaaatgtttcttccatttaaaaagttgccaactttgttgattaccatgaagccatcttgtttatataacatgttacatttaatttccgtgtgccagataaaggaatagcattagatggtatggtctaaaagtttatgattaggtattgaaaacaaattaaataattcatttaaagtaagtgtatgcttattagagtgtcattcaggttgctgctcaaatataaccctctcagaggggctgtttcagcccataccttctgaaattgccacgttccaggcaaagaaacaacattcagaaatgaatgcataaataagtttaaaatcctgaacaaaaagtcactactataattttaatttttatgccaatgaaagcgtattcatgtaggataaaaataaaaagtttaggccaggtgcggtggctcatgcctgtattctcagcactttgggaggccgaggagggctgaacacctgaggtcagaaattcgagaccatcctgaccaacatggtgaaacccgtctttactaaaaatacaaaattagccgggtatagcggtgtgtgcctgtaatcccagctacttgggaagctgaggcaggagaatcccttgaaccccggaggcagagggtgcagtgagctgagattgcacgattgcattccagcctgggcagcaagagcgaaactcggtctcaagaatgaatgaatgaatgaataaataaattaattaattaattaatttaaaaatatctgctgcagaaagtatatatggctgcatatattttttgtcacacttgcagtttgttactttccttaatggttgcatttaagctaactaggattttattttcagtatgctctccttgaatatctttaaagcagaccaaatatggatgatttttcagctaattcgggttttgggaaatcttaattttaaaatttatatgaaaaaatcataatggattttgcacagatgttctgttaccataattgatagttttaaaacatttttgtctttagagaattactttttactataagataataataaaatttgctatttaaattggtattaaggcaattttgttcgtaatccttaatagagaaatttctgcattgtacaaaataataaaatgcttcctcggtttttggacatcacttaatgtttatttactttaagacataaagttgtttatgcttaattgtcaatttttataacgtttatgttctttggtttcttttattgtgcatatggtctataaaacttgctttatctgtagaccttacataacaaagaatcagagtttcaataaaataaatatttaattttaaataagacctaaattataattatttttgaaatatataatatgtcatatttttaatagtatagtttgtacatttcaaagaaaatttaaaaaatagaaaaagcaaagagaatgttaccaattatttaatcacttatgtaagaatattgttaacatgttagcactaatataagcccattatgatttttttccttcaactgttttttatgcatagttttgtgttgtaattgtaattttttaatagcaatacctgaacacgtgatttttctagcacaatattaaattataattttttttgatatttgagcaaccataattttattaacataataatacccaatggattttggctatatcatcatttacctatgatttatccattgaaattattaaactcttaattgaatatctgtatgtaccagacatttgtttttgttcctgaaattctgcaagaaaggccataaatttccttttatcttacaaagcttaccttctatggagtaagacagtcgataaactaataatgctataatatacgttagatgattataaggactataatgaaaacaataaaacagaatagaatttggagggggatgatatgcatttacattattcatggcatgagaaggtttctatttttctggttttacatttgctgttagaaatgaagaatcaagaaaacaaacttaaggcaaatgagggccaaaaacaaaatagatacacaaatatttgatgaataaatgaaaaaataaatcagtttagtaattctaaggaatttggacttattctaaaggaaatggaaaacaacttgaatatattttctttattgaataatgtcatcaatggatagaaacagaatgaagctggaaataagtaattattaaagtaaatttttttacggaagaaataaatacaagtaacatcatgaaaatagtaactgaaactaagatagaaaagcaagaaccataaaataagcaaaatcttgttattgatttgaaatagaaagaattataatcatgaaataatactatttttccaatttttagaagaatgtgatataagaaatctcttattcctctgtggattttattaatacattaataagatgtatcaatatggttcttaaagttgatctgcactttcattcttgaaatgtgattatagatttatttgtttcagaagcactaagattttttattgttaatattttcatatgtaatatgaatttaaaataatttagaacttttaattcccgtattgtcaccatagttcatttctcattctaattaactttatttccaattttgtttttagtaggctttaaagggtctatacagttattcatttctttccttgaatgtattgattgcattatctttctgttatctaattcaaatatttctgctttcatctttattagttcatttttctgcttttctttggatatgtttgttcttcttttaaattctgaagatgaataagtagctcaagtcttttctttctgttatttaaaaacaccatattagggtctgctatggtttagatattgtttgtttgtcccaccaaatctcatattgatatttgtccccactgtggtgatattgatagggagggccaagtagcaggcatttggttcctgggggaggatctgttattaatatattaatactcttgctcaggcatgagtgacttctcactctgttagttctcaggaggcctggttgttaaatagggcctggaaccactcctctctccagcttgcttcctccttgcagtatgatctctgcatatgctctctctgtttctcattccaccaagagtgcaagcagcccgaggccctcactagatgtagttgcgaatagtgaacactttagccatcagaatcatgagccaagtaaacaatttttctttgtaaactacccaccctcaggtattcctttatagcaacacaaaacaaagacggggtataagtttgtgacttcaccttaatgtaaacttgtgcatttgtcctataattattttatcattgttttctaaggagtcagtttcatattttatttatatattaattgatagttattaaggacataaaacagttcaatatgattccattcttttaattgtttccttttaattatagaaaatgttaatattgacacaaaaacagagaattaatacatctacatgtcctcaaattcaaaaagtatctacttaaggccaatcttattttatctatgtcctcacattcaaaaagtatctacttaaggccaatcttattttatccatatcctcaccctctacttctccaaaataataattataataaatataaatatataatatacattatgtttaataaataattaaaaattataaaaataatataatataataataattattattattctttttgaggcagagtctcactctgtcacccaggctggagtacagtggtatgattttggctcactgcaacctctgcctcctgggttcaaacaattctcttgcttcagcctccccagtagctaggactacaggcatgtgccaccacgcctggctaatttttgtatttttagtaaagacagggtttcaccatgttggccaggctggtctcagactcctggcctcaagtgagttgcccacctccacaattatttttaagtgaattttggaaatcatataattttatttataaattgataatgtttgatgtgtttctaattctgtattataagttgttcttcctccataaaattttaatttttacatttaattttactgcagaaaccaaccagtaagttcttagaaaatttcaatctagattttgctgattgcatttccaagtgtctattagcatatttctctctgcccctgtttttttccttataaattgagaggtagatctggaagtttgattatagtaaacttcaagcttttggcaaaatcactttatatatagtggttcatagttatatctggaggtaaacaatcttcctgtctgtctttatttgtgatgcaagtaatcattgatgatttttgccaatatccatcatctcattaggggttacaaaacaatgatagtttaatttaattattcttcctagtggtgacgattctacaaaaaaaattgctcatcaacaattgagttgccttcagtaataattttatataattgatagaaaaacattagattctctacttttatttgtcagttttcaaaatactcagttggtacacttacatcatttaaatgtgactgaggatttttgttgtggttggtttgtttttatcattaaaaattcatgtttaaacattttttatttgttaaaatggttggaattgttgttatttcagttacattttagttcttaattttattgtgaacagatcagatcaatatattgtgtttttgttattttattcaagaatagaaaacaagaaaaataaagcaacatgtttgtaaaatgaatcatagatggtaagcaagaagattctgaaacatgttagatatagattaaatgagtagatcatttatatgcagacatagacaagaagagatagaattaacatgtattaaatattcatgaagcatcaaatttttaggacagttatatcacccttaagtcagtcacccattggtatcactcatctggcccgatatcttctctatctgaggtatgtagaaacaagctatggtattgcacagcaaattgtagaaaatctaactactggtcaggaatttttcccctgcatctcttccataaaataaacacgtgtattggttactggcatcttcattcttctaagccactttgaccacattcaattgttgtttcttatagccgtattatagcgaggaaggctgatgcaggagaaggtgagatagtggttcagaaagaaaggagggaaggaggaagggagagaaggagggagggagatactgtggtccttctatccatgctgccaaggctgtattaacctaaattggtttggtcatgttttaagtggattcaataaaccatgcagtttggggatctctagttcatttttgaggctttctattctgtgacttttaggatagagtaccggacagtgcacttgacaggtaatagcatcaccgtgatttcccactgcaagggtagcccaaacccagggatgaattgtgactttcatttgtccctttcttcataaataaataaaataaaatgtatattttatgactatactggtataaatatgattatattatgttaaaatataaaagttcattttttcttgttttaaaaaaattattttatggaccccctaaaagtattgcaggccctaggcactgtgcctacgatattttatgaatatgttagccctactctagccttcctttttgctattttttcatacttttgtttttctatttttttaaaagaacttagattatacaaatattaaaatagaaagcaaaaatttatcctatttcaacacatggctatttgtttacagttatatatatacatatatatacttacaggttatgttttcttctttttatactggaacacactatactctatggttttatactatgattcctgttctttaccttgaacttttcattaacaatgtattgtggacatatatattgtggagataatatcttagagatcaattacagtgggtatcatgtgtatttgcaggattattatagaatattcagtagtgctatagagaataagaggaataaaagaataatgaggaagagatgaaatcatagatagcaaacaattaggttgtgagttgtgttgtcataaaattcaaatgaggtgatgtctgttaaaccactcattagacaggaaatgcaatttatatttatttctatgtctaatggtaatctaaatttaacagtataagatttaggggtgctatggtttgaatgcatccctgctgaaattcagatgttgccaaagtgatagtattaagaggtggggtctttaagagggattagggcatgaggactccatgtttctccattgtaaattggagtaagatccttataaaagaggcttcttgttggttttggctatctgttgtccttctaccttctgctatatgaggatgcagcatgaaggacctcatcagatgcagtaccttgattttggacttctcagcctctaatgaatttttgttttcacacattacccacactcaggtattctattacagtagcacaaatgggctaacacaggggaggtcctttagatagtcccacaactagcaccaaaacccctggttagtaacataaggagacaaagctttacaaagtgtgaaaattctctagaggttggttctagttgatggcagattgaaaatatcaactgtgcaatgttattgccaaaattaaacacaaagaagccagccagtaaacaaataggtaatatt

SEQ ID NO: 873 - DNA, 7889 bp, Homo sapiens
aaaaaagtgcactaaaaacagtaaactctctgtatttgtgaatagtgtcttggccttccccaatcaagcaaaggtatgccaacaatgcctcaataatttgtttaatttgtttcagctttattgaggtataatgatatacaaaaattttcatgcatttaatgtatacattttgataaatttagatacctgtgtatacccatggtaccatcacaacacccaagatactaaacatattcatcacctccaaaagttttcttgtgttttttatttagtggtgtgtaggttttgtttgtctttgtttgtttgataagagcatgaggtctttcctttaacttattttaatgtatataacactgtattgttaaccctaggtactatgttatgcagcaagtctctagaatgtatttttattgtaaaactgaaacttcgtacccactgggcaacaattttccattttccccaaccttatcccccggaaatcagcattctactctgtgtatctatgaatttcactcttttagacaccccatacaagtgaaataatgcaagatttgtctatctgttactgggttgtttcacttagcatagtgttctctaggtatgtctatgttgcaaatggcaggatgtccttcttattttaagaatgaataatattccattgtatgtatttaccacactttctttatctaactgttaataaacatttcatttttttccatatcttggctattgtgaataatattgcagaacctgggagtaaaaatatctctgtgagactgatttcaatttttttggacataaaaccgtaagtgaaattattggattatatagcatttttaattttaaatattttgagaaacctccttactgttttgtataagggcaaacaattctaaattcccaccaactgtatagaaggagtcccattcctccacatctttgataaaatttgttatattttgacttaataatggtcatcctaatagggctgagttaatatctcattgtggtttcaacatgaatttacctgatgattagtgatgttgaacaccctttcatatatgtggtggccatgtgtatatattctttggagataagtctattcaaatcctttgtgcattttaaaatctagatatgtatgagtttttttgctgttgagttttaggagattattattatattcttggatattaactccttatcagacacatagtttgagaatagtttatcccattctgcatgttgtctttttactgtgttgattgtatataattcattgtgcagaaggtttttagttaaaattagtttcatgtgtctatttctggttttgctgcctgtgcctttagtgtcaaatccaataaatcattgccaaaaacaatatcaagaaaattttatccattttcttcaaggagctttacagtttcatgacttagtgtttaatacatttttagttggtttttgtgtatagcacaaagtatggagttccatttcatttttttgcatgtggatgtcgaccacaaatttggaagtggctatcctttctccagtgtgtgatcttgacacccttgtcaaagatcagttggctgcacatgcacgggtttatttcttggttctctattctattctcttggtctatgtgcttatctttatattagtatactgtttctattattgtagctttgtaatatattttggaatcagggaatgtgatgtctccagccttgttctttctcaaaatcactttggcaattcggagtcttctgtggctccacatgaattttagtattgttttttctatttctgtaaacaatgccattgggattttgacagggataacattgaatctgtcgattgctggtcataatatggacatttaacaatataatccttttctataaacagggaatgtctttccatttatttgtctagtttaatttctttcatcagtgttttataagttttcaatgttcaagttttatctttatggttaaatttattcctaagtattttatcatttttaatgctgttggtaataggattgttctcttaatttccttttcagatagttcattgttactgtgtagaactacaagtgatttttatgtattaaattgtattctgcaagtttgcttaatttcttgattaattcttacagatttgcgaagtctttgggagttttgtacatataggattataccatcttcaaacagaggcaattttactgctcctttaaaatttggatgcattttattttgctgctgttattgcctaatttctttgggtaggatttgtagtactacgttgactagaattggtataagaggaggcatccttgtcttgttcttgatcttagacaaaaatactttgagtttttcaccattcagtatgatgttagctgtggaattgtcatatatggacttcattatagtgaattcatcaacaattgttgacctcagaatataagccaaacaaagcagctttctttcacaattttccctcatgaaggctttgtaggaaacctgaggcaaagtttgaccaattgccttttctacaaatggactgctggtctaacagactacaaacttttgatatgtaaaactttattccgtatagtgttgatttttgtatatggatactaaccgaacctttaaaaattataattttatttatgaatatcaattctcattttattttatattcttgctattgttggtataagagaataatattgtttgtgtgtgtgtccatgcacaaattgatcattttttttctgtcaaccctccttaaatctcttataagttctctaatatttattgaataaataagcctgtgttgggtgtaatatatgtgagtgttttactatcttcatatatctctctaaatcctagacactagactttttagaaaactgttaagtacagaatctgctgaccttcacccaagaagttagtgtcttttatatttgctgcagtaaactacacatttccctgttagagaaatgagatcattttgattgcattattcttatttgctcctctcaatctggcttaggtaatttttatgggaaatcatcaaaaggcagcaaattattttaatgatacttgtggatttctaataacagatatgtatttaaaattccaaaatcttaattctgctaggacactggtttttctagaattgctccttaactaaatcctttcccaaagcaaaaagacctcaaaagccttgcaagtcttcaaaggttcatccctgttaaggtaaagaatttcatggcattgcaattctttatgtctcagtagggtattttccaataacatctcatcaggagacatttcatgactacttcattgtctcacctgatcaagagggattctctttacttctctataataacaacatgaagtctagagtgtgagtgtctttgactcaccagtagtgtatcatattaatgaaacaagcagttcactatttttcctggaccattttttaactcttatctcttatgtgtgatctatgtctgcttagtacatttgagtggagccacttcaaagatagttcatctctccctcaggaaaaaaaaagggtaaagtgtctcagaatttttttctgagggtaaaatcagcaaagtataatacaatgcaatacactgatgtcatcagaatccatacatagccatttgcagcatttactttcagctaccaaggaaacatagaatcaggctattcaatggtaatttctggaaaaaaattaacttaataacccttgaattatggagtaaaatttgattgtttcatgagtaaaaggactagatttacttccatttagatatatagtgacttataataactaaaaacttacagaatatcacattaaaaaatcttaaaattatggtttttatttcaagattaaatgtggactgcagttaatatgtagctgtgtatatagtatctaagtatgctataaagtaattttcaaaataagaaaatcattaatttatgaagacattactacccataaaatacttttcatatacatgtactaaacatccagaaatgtaaatatgaatttcagagtctgttttttcttttttcttagcaaaatattatttcatggaacattttttaatcacatttttcctcctttcctattctctctaaactacctatcacatagcctcttcctctatcctcttttgaaaatcattttgctgggatctcaattacctcttaattgcccagtctagagaagacagtgcatttaatgtcttctaagacctctcagttgcattgcatatttttgaccttacgctcattattgcaattcttctttgctttctgggacacaatgttttgcttatacgcatgccaccaccctgaaattctgtgcttggctttcttctcacttatattctctctctgagtcatttcatctatttctataacatcaaatactctttacaggcagaattctactaagtctatacagttggcccttgaacaatatgggtttgaactgcacaggtccacttatatgcaaatttttgtcaataaaatatacactgagtgtgcctgcctctctctaatgcctcctctccatctcctccacctcttctgtctctaccaccagagacagcatgatcaaaccctccttttcccccacctcctcagcctactcagcatgaagataaaggatgaagacatttttgatgatctacttccatacaatgaatagtaaatatattttctcttccttttgattttcttaataacattttttctatagcttactttattataagaccatagtatataaagtatacaacataaaaatatgtgccaattgactcatgttatcagcaaggctgtggtcaacagtaggatactaatagttagattttaaaggagtcaaaatttgtacatagatttttggctttgtgggtgtcagcacccctcactcccatgttgatcaaggtcaactgtattttcattgcagaactattatctgaattctggactattattatcaactctggttctgggcatcatatgcatcacatgctgaactcataagctctactccataagcatttatttacctactctgacctgttttagttagaagaaccatttttttctgttatattcttaagtctgaacctttcatgttccagatttagatttcactatcaaattctatttatatggagtatatcttgtctattttactccgtatttctcattcagtctgcttattagccacctaactagtgttttgttctttatttttatgcagtccattcttcacaattttagtagaataatctttcaaatattaaataagtacttcaacttaaattgatttggtatacaaaataaaataattggtttttgtaaaattgcaagatagttactcaaaatctagcaaatatttcttattgcatttgtgatgtctatataattgtataatcaattcttatacacaattgagtctctttctgggcaatcctttccaatccattgttattgttgctgatttgtggactgtgctactctatattatgtattatgcctttatgatttagtcagatattttaaaaatccatattcttcacaatagtcttttatttataaattactttttatatagtcacctattgatcttttttcaaataattttgtgactcccccagaatttcatttgaattgcattggagctatggtataatattgggagaactgattatttttgtgtatcattgcttttgaataatatgatataccaacccatttattctctcaaagtgttatatccctaaattaaaaaaaagttgtttctttatagatttcaaacagggaattagaaagaggattgaaagatcccttttcaccactttatttttcaaggcaaaattgtggcaagaatattcccttctaacaattttatataatttaggattggaaccagaaagttagtcattcattcttacctctcctctctaaagcacaactaattatctgtgactttttgaagtcactcttccctgaacatctaaagagagtgatttaaggtcaaatttgggcagagatagctgaaagtccattacaatttggtatttaataaaaaaatgtgaccttaatttgtagtcacaactggtggagtggggatattataactgcaatttaatttatgacaagatggaactgtaaaacatattttctttattgtctgctatgtttatatagtccaagagatgatccatgtctctgatggagtcaagctaacaaaacgaaataaaagactagtctttaaagtagaacgataaattattattttaaaatagcatgtatcaacttctagtggtcatagttgccaaataaaagtagtaatattagtaataatggctcttatttattaaaaaaatactctgttccatgcacagagggagtataataagccttacgtttcagagtttaggctctgttaaactttttaagttcagccttggctctttcaattaatcagtctatttcttggggcatataacttaacctccaagtgccttagttttatcattttgaagcactttaaaatgcctaagatagctgttgtggtgatgaaatgatatatgtaatgaacttagcatagtgcctgacacatactaaatgatcaatgcatgttaggtattacttagataacaaggataatattctgaaagtattaaatctattaatttaatctaatttaatttattcttatgttcatttaagttatattttcctgcattcttgctgttgttaagactaaaatatgagacttatcatccaaaataattttcttttttaccacccttgactctcaaaactcccttgaaataataaacccaggctttattgagggaaaaaatatatttttgcattttcttacaaactaaaagacagttctagtgtgctcaggtcaccaaacttttataataccataagtgaaaggaaaagagacctcaggatatgacattggagaaaggagaaggtatactcaggattgagagaataaagaaaaggttgggcaagaggtcctatttgagagctagggatggtagaaatcccaaatgagttgagggtgaagcccaaagcagaaggtcttagacctggttgtctgcctggaactgtgggtagaggccactaaatacgtgtctctgagctaggaaaaaaaataacagtttagtgagtttagagaatcataaacagagtacctggttctcttttgggtgttaggttttgagaacccagaaattctagcatactctcagaattgaagcaaggagttgaaagttagtggagctgtcctaggaccataaaggtaaaaggctggggagactttccaggagagcccatgaggtggattagtctttatggaagttacaactgatagtaaatgcacagctgatgataccttgggtgggacttattcattaaagcggggatttccctagggacgagactgaaagctgaacatgctgttgacctcaactggcatggacatttgctaccagaatgtccactgagcaagaatcactggaactaccactgttgatttagagggtggtacaaacacctacatttatgtcagttgctcctttagccaccaccagagaaataactatgccatatgggggtaaaaatataaataactcaaaaagactaatttttagtgaaagcattccagttcattcaaaagaaactgaattaatattagttgactaaatttgtactaatcatatctcattccaccatccacaaaaatggggacttcatgggaatctgaaaatagtattagaaagtaaagaattatgctcttttcccccatttaaggcatgaagtgtatgtgttgac

SEQ ID NO: 874 - DNA, 11316 bp, Homo sapiens
accagagttcatagttacaggttagtcatagacaagaatttaggattcttagaaatccccagtttaagtggtttgagtactctgggggatttggtttgctgtatagtaatggagttgattgtacagtggtacccatatcaataagaaagctatattattatctatttatattataagtaattcccaatggagctttaaaacgagatagaaaattgctggtgcttatgtttctgttggatcaactgtctttggacagttttttttttttttaatcagtgtgaggcattgatgttccaatgatcttttcttccaatatctacaagaatccttacttataagctttatgttcttagatagtagaaaatcctttcttactgtgtttgtttgtttgtgtgtttgtctcatctggagagctggagtatatatatagagtggaatgattgccacaatcaaagtagctaatacattcgtcacctcacataattaccattgttttccttttgtggtgtgaacacttaagatctactctcttacaaaatttcaaatatcaaatatagcataattaatgatagacactatgttgtaccttagatccccagaactttttaatcttacaattgaaagtttgtagtctttaccaacatctacccaaaccttgccccttccaaaccttacccctggaaaccatcattctagtatgtgcctttatgagcttgactttttactattacacatacaagtgagaacaaacagtatttttctctctgtgtctggcatatttcacttagcataccgttctctagtgttattaatattgccacaaatgacagaatttccttccttttatggctaaatactattccattgtatgtatagacaacattttctttataaaatcattcattgattcacaatttggttgttttcatattttgactattgtgaagaatgttgcaataatcatgaggttgcaaatatctttttgaaaaacttatttcatttccttcatttatatatccagaagtggaattgctgtttcatacgggtagtttcatttttactttttctgaggatcctccacaccgttttttatgatggctctaccaatttacattcccatcaacagtgtaaaagggttccctattctctacatcttcaccagtacttattgtctctttgctttttgataagaaccttcctaacaggtatgaggtgatatttcattgtattcttgatttgcatttccctgatgattagtgatgttgaacactttcagatagctggcagttgtttgtatatcttctttggaaaaatgcctattcagaatctttgcccattatttaatagggttgtttatctatttttgctattgacctgtagaagattattacctaatttggatatcaactctttatcagatagtttgaaaatattttctcccattttgtaggttgccttcttatttttagttgtattatatctttcagttccagaatctctgtttgattcttttttttatggtttctattttttcattaaacttctcattgtcttcatgcagttttcctgattttgtttagttgtatatctgtgttctcttgtatcttgttgaactcaagataatttttttaaaattgtttgttaggtaatttatagatttctgcttctttggggtagtttattgacactttattgatttcctatggtgatgttgtgttagtctgactctctatgatttgtgtggcattgagtttgtgtctgtgtattaaggggcaaaacactttttctaatctttacagatgggtttcagcaggcaaaaaccttctcctgtcaatttcttgggctaatgagattccctttgggatccaggttgagtggggttggagccaggtcacatggctgctactagatctgaggttgacagccctatggctaggagttcaggtgggtatagctcttgcttaatctttgaataggcaagactacattcagaaccttggtcagtagagctggtactgaaacaagtttcaaggtctgcagttagttctgcacgtggtagacctgttaccagattcatgtgtagttttggctcctgcaggttccctgagaatattccccctaggtcactgggtgtatttctgggtgtttatggctgctcctgaccacagctgagggagaatggagctgggtcatgggccacttcaggatccactcccagaaccaagttggtgggcctgttacttgaggcatgggaaggtgtggctccatttgggtgtcctggagtatggcgctggtggcaggaccaaggccaattggagctgtaactgaatccacaggggtatggggctgtttctgggttcctagtcaagaccatgatcaatgagcctgtcatcaggttgcaggcctgatctctcaatatagctctctttggtcttcagattcatgaggatttcacaacatgctacttggatttcattgctctacaaaaaagtatttttgtctggataactaccaaattattactgctggaagggaatgtgagtggaggacctacggttctgccattttactgttctcactccccaccaaatctactgtgaagaaaaaggggtttctaacggtcttatataatgtatttcctacttgttcttggcttttcaaggccaaatttttgacatatgtgtattgggttttttagatttcctcctgatgttttctattatgctgctttcaacttgtaattaagaaaaaaagttgataaaaatttagtactccaagacgttaattatctaagaaaacactgaattgcacagcagattttacctattttttgaggcttagggaaattcttaattatagttcttaagaactctagactaaggtttaagtacaacttctatagacctgccttctagtccagcaatgggatttttaaaatgcaattgtttatttcctgagaaataccatgaggaaaatgtttcttatttatgaggtcaggggaaagagcagaaggaatataagtggtataatttatgaggaaattaagtctgagagtaaaagaggtacaagagggggaggcttcagagatttggaaggagtttgattgttttttccttggacttttctacaaagtctttgagggtttctatcttggagtcaatattttgattttaggacttcatataagaaagtcaatcacagattacttggtatttgtctcaggtctttttttttttcagagctcctcgtaaatgtattattcttgatatgtcagaagtttcccatattggccattgtaattcttattaaatcttcctatttatcaagataagcataattatttgagttagagtaagacaaaatataggaagcagacgttctgccagaggaaagtcagctttaatgtagagatgaacttgagattaacaaaaaagtgcactaaaaacagtaaactctctgtatttgtgaatagtgtcttggccttccccaatcaagcaaaggtatgccaacaatgcctcaataatttgtttaatttgtttcagctttattgaggtataatgatatacaaaaattttcatgcatttaatgtatacattttgataaatttagatacctgtgtatacccatggtaccatcacaacacccaagatactaaacatattcatcacctccaaaagttttcttgtgttttttatttagtggtgtgtaggttttgtttgtctttgtttgtttgataagagcatgaggtctttcctttaacttattttaatgtatataacactgtattgttaaccctaggtactatgttatgcagcaagtctctagaatgtatttttattgtaaaactgaaacttcgtacccactgggcaacaattttccattttccccaaccttatcccccggaaatcagcattctactctgtgtatctatgaatttcactcttttagacaccccatacaagtgaaataatgcaagatttgtctatctgttactgggttgtttcacttagcatagtgttctctaggtatgtctatgttgcaaatggcaggatgtccttcttattttaagaatgaataatattccattgtatgtatttaccacactttctttatctaactgttaataaacatttcatttttttccatatcttggctattgtgaataatattgcagaacctgggagtaaaaatatctctgtgagactgatttcaatttttttggacataaaaccgtaagtgaaattattggattatatagcatttttaattttaaatattttgagaaacctccttactgttttgtataagggcaaacaattctaaattcccaccaactgtatagaaggagtcccattcctccacatctttgataaaatttgttatattttgacttaataatggtcatcctaatagggctgagttaatatctcattgtggtttcaacatgaatttacctgatgattagtgatgttgaacaccctttcatatatgtggtggccatgtgtatatattctttggagataagtctattcaaatcctttgtgcattttaaaatctagatatgtatgagtttttttgctgttgagttttaggagattattattatattcttggatattaactccttatcagacacatagtttgagaatagtttatcccattctgcatgttgtctttttactgtgttgattgtatataattcattgtgcagaaggtttttagttaaaattagtttcatgtgtctatttctggttttgctgcctgtgcctttagtgtcaaatccaataaatcattgccaaaaacaatatcaagaaaattttatccattttcttcaaggagctttacagtttcatgacttagtgtttaatacatttttagttggtttttgtgtatagcacaaagtatggagttccatttcatttttttgcatgtggatgtcgaccacaaatttggaagtggctatcctttctccagtgtgtgatcttgacacccttgtcaaagatcagttggctgcacatgcacgggtttatttcttggttctctattctattctcttggtctatgtgcttatctttatattagtatactgtttctattattgtagctttgtaatatattttggaatcagggaatgtgatgtctccagccttgttctttctcaaaatcactttggcaattcggagtcttctgtggctccacatgaattttagtattgttttttctatttctgtaaacaatgccattgggattttgacagggataacattgaatctgtcgattgctggtcataatatggacatttaacaatataatccttttctataaacagggaatgtctttccatttatttgtctagtttaatttctttcatcagtgttttataagttttcaatgttcaagttttatctttatggttaaatttattcctaagtattttatcatttttaatgctgttggtaataggattgttctcttaatttccttttcagatagttcattgttactgtgtagaactacaagtgatttttatgtattaaattgtattctgcaagtttgcttaatttcttgattaattcttacagatttgcgaagtctttgggagttttgtacatataggattataccatcttcaaacagaggcaattttactgctcctttaaaatttggatgcattttattttgctgctgttattgcctaatttctttgggtaggatttgtagtactacgttgactagaattggtataagaggaggcatccttgtcttgttcttgatcttagacaaaaatactttgagtttttcaccattcagtatgatgttagctgtggaattgtcatatatggacttcattatagtgaattcatcaacaattgttgacctcagaatataagccaaacaaagcagctttctttcacaattttccctcatgaaggctttgtaggaaacctgaggcaaagtttgaccaattgccttttctacaaatggactgctggtctaacagactacaaacttttgatatgtaaaactttattccgtatagtgttgatttttgtatatggatactaaccgaacctttaaaaattataattttatttatgaatatcaattctcattttattttatattcttgctattgttggtataagagaataatattgtttgtgtgtgtgtccatgcacaaattgatcattttttttctgtcaaccctccttaaatctcttataagttctctaatatttattgaataaataagcctgtgttgggtgtaatatatgtgagtgttttactatcttcatatatctctctaaatcctagacactagactttttagaaaactgttaagtacagaatctgctgaccttcacccaagaagttagtgtcttttatatttgctgcagtaaactacacatttccctgttagagaaatgagatcattttgattgcattattcttatttgctcctctcaatctggcttaggtaatttttatgggaaatcatcaaaaggcagcaaattattttaatgatacttgtggatttctaataacagatatgtatttaaaattccaaaatcttaattctgctaggacactggtttttctagaattgctccttaactaaatcctttcccaaagcaaaaagacctcaaaagccttgcaagtcttcaaaggttcatccctgttaaggtaaagaatttcatggcattgcaattctttatgtctcagtagggtattttccaataacatctcatcaggagacatttcatgactacttcattgtctcacctgatcaagagggattctctttacttctctataataacaacatgaagtctagagtgtgagtgtctttgactcaccagtagtgtatcatattaatgaaacaagcagttcactatttttcctggaccattttttaactcttatctcttatgtgtgatctatgtctgcttagtacatttgagtggagccacttcaaagatagttcatctctccctcaggaaaaaaaaagggtaaagtgtctcagaatttttttctgagggtaaaatcagcaaagtataatacaatgcaatacactgatgtcatcagaatccatacatagccatttgcagcatttactttcagctaccaaggaaacatagaatcaggctattcaatggtaatttctggaaaaaaattaacttaataacccttgaattatggagtaaaatttgattgtttcatgagtaaaaggactagatttacttccatttagatatatagtgacttataataactaaaaacttacagaatatcacattaaaaaatcttaaaattatggtttttatttcaagattaaatgtggactgcagttaatatgtagctgtgtatatagtatctaagtatgctataaagtaattttcaaaataagaaaatcattaatttatgaagacattactacccataaaatacttttcatatacatgtactaaacatccagaaatgtaaatatgaatttcagagtctgttttttcttttttcttagcaaaatattatttcatggaacattttttaatcacatttttcctcctttcctattctctctaaactacctatcacatagcctcttcctctatcctcttttgaaaatcattttgctgggatctcaattacctcttaattgcccagtctagagaagacagtgcatttaatgtcttctaagacctctcagttgcattgcatatttttgaccttacgctcattattgcaattcttctttgctttctgggacacaatgttttgcttatacgcatgccaccaccctgaaattctgtgcttggctttcttctcacttatattctctctctgagtcatttcatctatttctataacatcaaatactctttacaggcagaattctactaagtctatacagttggcccttgaacaatatgggtttgaactgcacaggtccacttatatgcaaatttttgtcaataaaatatacactgagtgtgcctgcctctctctaatgcctcctctccatctcctccacctcttctgtctctaccaccagagacagcatgatcaaaccctccttttcccccacctcctcagcctactcagcatgaagataaaggatgaagacatttttgatgatctacttccatacaatgaatagtaaatatattttctcttccttttgattttcttaataacattttttctatagcttactttattataagaccatagtatataaagtatacaacataaaaatatgtgccaattgactcatgttatcagcaaggctgtggtcaacagtaggatactaatagttagattttaaaggagtcaaaatttgtacatagatttttggctttgtgggtgtcagcacccctcactcccatgttgatcaaggtcaactgtattttcattgcagaactattatctgaattctggactattattatcaactctggttctgggcatcatatgcatcacatgctgaactcataagctctactccataagcatttatttacctactctgacctgttttagttagaagaaccatttttttctgttatattcttaagtctgaacctttcatgttccagatttagatttcactatcaaattctatttatatggagtatatcttgtctattttactccgtatttctcattcagtctgcttattagccacctaactagtgttttgttctttatttttatgcagtccattcttcacaattttagtagaataatctttcaaatattaaataagtacttcaacttaaattgatttggtatacaaaataaaataattggtttttgtaaaattgcaagatagttactcaaaatctagcaaatatttcttattgcatttgtgatgtctatataattgtataatcaattcttatacacaattgagtctctttctgggcaatcctttccaatccattgttattgttgctgatttgtggactgtgctactctatattatgtattatgcctttatgatttagtcagatattttaaaaatccatattcttcacaatagtcttttatttataaattactttttatatagtcacctattgatcttttttcaaataattttgtgactcccccagaatttcatttgaattgcattggagctatggtataatattgggagaactgattatttttgtgtatcattgcttttgaataatatgatataccaacccatttattctctcaaagtgttatatccctaaattaaaaaaaagttgtttctttatagatttcaaacagggaattagaaagaggattgaaagatcccttttcaccactttatttttcaaggcaaaattgtggcaagaatattcccttctaacaattttatataatttaggattggaaccagaaagttagtcattcattcttacctctcctctctaaagcacaactaattatctgtgactttttgaagtcactcttccctgaacatctaaagagagtgatttaaggtcaaatttgggcagagatagctgaaagtccattacaatttggtatttaataaaaaaatgtgaccttaatttgtagtcacaactggtggagtggggatattataactgcaatttaatttatgacaagatggaactgtaaaacatattttctttattgtctgctatgtttatatagtccaagagatgatccatgtctctgatggagtcaagctaacaaaacgaaataaaagactagtctttaaagtagaacgataaattattattttaaaatagcatgtatcaacttctagtggtcatagttgccaaataaaagtagtaatattagtaataatggctcttatttattaaaaaaatactctgttccatgcacagagggagtataataagccttacgtttcagagtttaggctctgttaaactttttaagttcagccttggctctttcaattaatcagtctatttcttggggcatataacttaacctccaagtgccttagttttatcattttgaagcactttaaaatgcctaagatagctgttgtggtgatgaaatgatatatgtaatgaacttagcatagtgcctgacacatactaaatgatcaatgcatgttaggtattacttagataacaaggataatattctgaaagtattaaatctattaatttaatctaatttaatttattcttatgttcatttaagttatattttcctgcattcttgctgttgttaagactaaaatatgagacttatcatccaaaataattttcttttttaccacccttgactctcaaaactcccttgaaataataaacccaggctttattgagggaaaaaatatatttttgcattttcttacaaactaaaagacagttctagtgtgctcaggtcaccaaacttttataataccataagtgaaaggaaaagagacctcaggatatgacattggagaaaggagaaggtatactcaggattgagagaataaagaaaaggttgggcaagaggtcctatttgagagctagggatggtagaaatcccaaatgagttgagggtgaagcccaaagcagaaggtcttagacctggttgtctgcctggaactgtgggtagaggccactaaatacgtgtctctgagctaggaaaaaaaataacagtttagtgagtttagagaatcataaacagagtacctggttctcttttgggtgttaggttttgagaacccagaaattctagcatactctcagaattgaagcaaggagttgaaagttagtggagctgtcctaggaccataaaggtaaaaggctggggagactttccaggagagcccatgaggtggattagtctttatggaagttacaactgatagtaaatgcacagctgatgataccttgggtgggacttattcattaaagcggggatttccctagggacgagactgaaagctgaacatgctgttgacctcaactggcatggacatttgctaccagaatgtccactgagcaagaatcactggaactaccactgttgatttagagggtggtacaaacacctacatttatgtcagttgctcctttagccaccaccagagaaataactatgccatatgggggtaaaaatataaataactcaaaaagactaatttttagtgaaagcattccagttcattcaaaagaaactgaattaatattagttgactaaatttgtactaatcatatctcattccaccatccacaaaaatggggacttcatgggaatctgaaaatagtattagaaagtaaagaattatgctcttttcccccatttaaggcatgaagtgtatgtgttgac

SEQ ID NO: 875 - DNA, 5906 bp, Homo sapiens
gttacaaaaaagataaaacatcatcattgatatttaaaatctcagataaatattttacctttttttgttgttatttttgttgctagctcctctctccacctccatgtattcacttgaaacagcctaggtcaatagctgcagaattttttttttcataccccagtggcacctggaacaccagcgagacagaacctttcactcccctggaaagggggctgaagccagggaaccaagtgagtggtctcacgcagcaggtcccactcccacagagcccagcaacctaagaaccactggcgtgaaattctcactgccagcccaagcagtctgaagtcaactttggatgcttgagcctggcagggagaggggcgtccaccattactgaggcttgagtaggtggttttcccctgaaaatgctaaggccaggaagttcagactggacagaactcaccacaactcggcaaagtggctgtggccagactgcctctctagactcctcttcactgggcagggcatctctgaaaataaggcatcagccccagtcaggggcttatagataaaactcccatctccctgggacagagcacctgggggaaggggtggctgggggcacagcttcagtagacttaaatgttcctgcctgctggctctgaagagagcagcagatcatgacaaggagaattctcccagcacagcactggagctctgctaaggcacagactgcctcctcaagtgggtccctgaccgctgtgcctcctgactgggagagatctcccagcaggggtcgacagacacctcatacaggagagctctggctagcatcaggccagtgcccctctgggatgaaggttccagaggaaggagcaggcagcaatcattgctcttctgcaagatctgctggtgatacctaggcaaacagggtctggagtggacctccagcaaactgcagcagacctgcagaagagaggcctgactattagaagaaaaattaacagaaagaaagcaataacatcaacattaacaaaaaagtacagccaaccaaaaaccccatccaaaggtcatcagcctcaaagatcaaaggtagataaatccatgaagatgaggaaaaaacagcgcaaaaatgctgaaaattccaaaaaccagaatacctattctcctccaagtgatcacaacttccgtctagcaagggaagaaaactggatggagaatgagtttgacaaattgacagaagtaggattcagaaggtgggtaataacgaactcctctgaactaaaggagcatgttccaacccaatgcaaggaagctcagaaccttgataaaaggttacaggaactgctaactagaataactagtttagagaagaacataaatgacctgatggagctgaaaaacacaatacgagaacttcgtaaagcatacacaagtataaatagccaaatcaatcaagcagaacacaggaaatcagagattgaagatacacttactgaaataaggcatgaagacaagattagagaaaaaagaataaaagagaatgaacaaagcctccaagaaatatgggactatgtgaaaagaccaaacctgtgattcattggtttacctgaaagtgatggggagagtggaacgaatggaaccaggctggaaatcacacttcaggattttattgaggagaacgtccccaacctagaaagacaggccaacattcaaattctggtaataatacagagaaaatcactaagattctccttgggaagagcaacccaaagacacgtaatcatcagattctccaaggttgaaatgaaggaaaaaaatgttgagggtggccagagataaaggtcaggttaactacaaagggaagcccattagactaatagcagatctctctgcagaaaccctacaagccagaagagagtgagggcctatattcaacattattaaagaaaagaaagttcaacccaaaatttcatatcctgccaaactaagcttcataagcaaaggagaaataaaatcctttacagacaagcaaatgctgagggatttttgtcactatccggcctgtcttacaagagctcctgaaggaaacaccaattatggaaaggaaaaaccggtaccagccattgcaaaaacacaccaatatataaagaccaatgatactatgaagaaactgcatcaaccagtgtgcaaaataaccagctagcatcataatgacaggatcaaattcacacgtaacaatattaaccctgaatgtaaatgtgctaaatgccccatttaaaacatacagactagcaaattgggtaaagagctgagacccatcagtgtgctgtattcaggagacccatcttacatgcaaggacacacataggcacaaaataaagggatggaggaatatttaccaagcaaatggaaagcaaaaaaaaaaaaaaaaaaaaaaaaaaaaaaaaaaagcagtggttgaaatcctagtctctaataaaacagactttaaatcaacaaagatcaaaaaagacaaagaagggcattacataatggtaaggggtcaatgcaacaaaaagagctaactaccctaaatatatatgcacctaatagaggagcacccacatacatacaacaagttcttagagacctacaaagagacttagactcccacacaataataatgggagactttaacaacccactctcaatattagacagatcaacgagacagaaaattaacaaggataatcaggacttgaactcagctctggatcaagcagatctaacagacatctacagtactcttcagcccaaatcatcagaatatacatttttctctgcaccacatagcatctatcctaaaatcgaccacataattggaagtaaaacactcctcagcaaatacaaaagaatagaaatcatatcaaacagcctctcagaccagagtgcaatcaaattagaactcagggttaagaaacttactcaaaacctcacaactacatggaaactgaacaacctgcttctgaacaactactgggtaaataacgaaattaaggcagaaataaagaagttcttggaaaccaatgagaacaaagagacaatgtaccagaatctctgggacacagctaaagcaatgtgtagagggaaatttatagcactaaatccccacatcagaaagcaggaaagatctaaaatcgacaccctaacatcacattaaaagaactagagaagcaagagcaaacaatttcaaaagctagcagaagacaagaaacatctaagatcagagcagaactgaaagagatagagtcatgaaagaccctccaaaaaaaccaatgaatccaggagctcattttctgaaagattaacaaaatagatagactgctagccagactaataaagaagaaaagagagaagaatcaaagagacacaataaaaaatgacaaagaaggtattaccactgatcccacagaaatacaaactaccatcagagaatactataaacacctctatgcaaataaactagaaaatctagaagaaatggatacattcctggacacatacaacctcccgagactaaatcaggaggaagtcgaatatctgaatagaacaataacaaccagaaaaagccagagccagacagattcacactctatttctgccagaggtacaaagaggagctagtaccattccttctgaaactattctgaaaaatagaaaaagagggtctcccccctaaatcattttatgaggccagaatcatcctgataccaaaacctggcagagacacaacaaaaaagaaaatttcaggccaatatcactgatgaaaataaaataagatactggcaaattgaatccagcagcacatctaaaagcttatctaccatgatcaagtcgacctcatccctgggatgcaaggctggatcaacatacgcaaatcattaaacgtaatccatcacataaacagaagcaatgacaaaaaccacaggattgtctcaatagatggggaaaaggccttcaataaatttcaacaccactttatgctaaaaactctcagtaaactaggtattgatggaacatatctcaaaataatatttatgacaaacccacagccaatatcatactgaatgggcaaacgctagaagcattccctttgaaaactggcacaagacacgatgccctgtctcagctcaccactacaattcaacattgtattggaagttctggatagggcaatcaggcaagaaaaagaaacaaaaggtattcaaataggaagagaggaagtcaatttgtctctgtttgcagatgacatgattgtatatttagaaaactccatcatcttatccccaaatctccttaagctgataagcaacttcagcatagtctaaggatataaaatcagtgtgtgaaaatcacaagtattcctatacaccaaaaatagacaagcagagagccaaatcatgagtgaactcccatgcacaattgctacaaagagaataaattatccaggaatacaacttacaagggacatgaaggacctcttcaaggagaactataaactactgctcaagaaaataagagaggacacaaacaaatggaaaaacattccatgctcatggataggaagaataaatattgtgaaaatggccatactgccccaaggaattcatagattcaatgctatccacctcaagctaccattgtctttcttcacagaattagaaagaactactttaattttcatatgaaaccaagaaagagcccgtatagccaagaaaatcttggaggcatcatgctacctgacttcaaactatactacaaggctacagcaaccaaaacagcatggcactggtatcaaaacagatatgtaggccaatggaacagaacagagtcctcagaaataacaccatacatctacaaccatcagatctttggcaacctgacaaaaactagccatggggaaaggattccctatttaataaatggtgctgggaaaactggctagctatatgcagaaaactgaaactggaccccttccttaaaccttatacaaaaattaactcaagatggattaaagacttgaatgtaaaacctaaaactataaaaaccctagaagaaaacctaagcaataccgttcagggcatacacgtggacaaagacttcatgactaaaacaccaaaagcaattgcaacaaaagccaaaattgacaaatgggatctaattaaaccaaacagcttctggacagcaaaagaaactatcatcagagtgaataggcaaactaccaaatgggagaaaatttttgcaatctatccatctgacaaaggtctaatatccagaaactacaaggaacttaaacaaatttacaagaaaaaaaaaaaaaacatcaaaatgtgggcaaaggatataaacagacactctcaagagaatacatttatatagcagtatttacaatagccaagacttggaatgaacccaaatgcccatcaatgatagactggataaagaaaatgtggcacatatacaccatggaatactatgcagccataaaaaagaatgagttcatgttctttacagggacatagatgaagctggaaaccatcattctcagctaactagtaagaacagaaaaccaaacaccgcatgttctcactcataagtgggagttgaacagtgagaacacatggacacagggaggggaacatcacaccccatggcctgttgggggctgggggacaaggagagggagagcattaggacaaatacctaacgcatttggggcttaaaaccttgatgacaggtagataggtgcagcaaaccaccatggcacatgtatactatgtaacaaagctgcacattctgcacatgtatcccagaacctaaagtaaaatttttaaaaaagtaatatatatatacctctaaaataaaagaaatagcctagc

SEQ ID NO: 876 - DNA, 3090 bp, Homo sapiens
attatcaattcagtaggaacagaggggaagggaaagagacaggttttagaggtaatgttctaaaactgtaatttggaaactgattagattaatgggatacaggagaggctggctacaaaatttgcaaagcccagtgcaaataaatgatctgaaaactgaaaaaagatagagcccccttttcaaaaatcaggaaaaaagtaccaataaaggtattaaaatataaagcttaggccagacggagtggctcacgcctgtaatcccagcactttgggaggctgaggcaggtggatcatgaggtcaggggttcgagatcaacctgaccaacatgatgaaaccccatctctactaaaaatagaaaaattagctgggtgtggtgatgcgtgcctgtaatcccagctactcaggaggctgaggcaggagaatagcttgaaccagggaggtggaggttgcagtgagtggggatcgtgctactgcactccagcctgggtgacagagtgagactccatctcaaaacaaaaggaaaatataaagcttattcctttaaaatactattacttacacattataagagggggtaatagaaataaaaacataaacttcaaaattgcagaaagataatattttggcatcataattttatataatacaacaaatcacaatattaatgtgatatgttgattgaacacaaatttattgggcttttctgcagtgacttatgtcatcatgttacatacttttaattcaaaatactttgttttcagttaaataattgaaagtgaacagtttctcttggtaaatgcaagatctcaaataatgttttgataatttttaattttgagaaaggtcttttcgctgatgtaaatgttattgaaactgttaagggcattttataggctgtaaaaacataaagataaattactgataaattattacaaaatttatgttttattacagctagagttgaggtcatggaacaattttttctaaaaaaaaaaattaacttcacacaaatcaattttgtgtaatttttaaatgtaaattcattttaaaatgtaaatttatacaatagcattttagtatttctctggcatttcatgtaacttttggaggttatgtggatatgttattaaaatagcttcattatttgtgtatcattaaaaacagctgtttatgtattttatcaccatattttcaattataagaaaaaagtctaaaatcatctttcttattaataatttttcattagaagttttattgaaaatatgttcttttccattggatgtgatgatatttgaatttaatttcatttctaaatctgtggatatttattttgcaatgttgtagcactttacaaaaccagagattttaagttcttatagaattctaatcattttctaatatgctttattgcaatgttcatgtgtacacagttattttgtaatatttactgaaagtttactccttgattgcagcagtgcctgtcccagcactctggctggagaattaacatttgcacacgcactgcaatgacaggtgctcgagccagagggtaagctggcctcttagtgcaggaactagcctttcctccaggtgaagtatctttcctctcctagtcatggtcacttctgctgctgctatcaccaatttgggccctagtactaccaagccatgtcctcagagcctcctagcccacagacttccccaaggcatgcccgtgcctgcccaacagaacagctgctgtgtgcgctgcccttgttcccccagctgctgctgggccacaaccctaccgcctgacatctctcctctcctctgatcctgcacttgctctttgtcccatcatatttcacttacaaaacattaatttcaaagatgaaacaaagggagtccagatgttgaatgcagagcattaaaccaaatgtggggaggggatcttctcagcatggggtctgtgggactgcacacgtcccagcccatggacctggccctgggtacgagggaggggaaagagcctgagatggttttgaacactgggaactgagtaagcaatgtaacaggctgtgttagtccctcttacactgctacaaagaaacacctaaggctgggtaatttttaaagaaaaaggatctattttggctcttgggtctgcaggctgtacaagaagcatagaaccagcatttgtttctggtgaggatgtcaggaagcttccactcatggcagaaggcaaatgggaaacaggtgtgtcacatggcaagacagggaacaagaaagacaggaggaagtatctgcttttaaccaccagatcttgtgttgacttacagagccagatctcattcattaccatggggagggtgccaaactgatacaggagacagaaagaaattaggcagatagtgagggcagaagagtcctctgcagaacttctcttttaacaaaaagtagcctgagaaatcatttcttttctaacaaagagcagcctgaaagatggagctgcaaacatagataaggaagctggaagcttgtacaggaggaggaatgtccaccatggggggtcctccttccctttttcattagcatgtatatagtaagaaagaaatgagcaacacggagaagctcaggcagagaacccgcctgcataataaaagattggggtgggggctgccagcaattcacaccctatgcagatggcacacctggtcctaactggttttttgtgccctatatagatcagacacggcctccacactagctcatctataaaaccccctgcatttcactacagatcagcagaccatttttccgggacccctttctgtggtagcaagctattctctttcttttgcctattaaacttctgctactaacctcaccctttgtgtgtctgcatccttgatctccatggctgtgagacaacaagccttgggtgtcaccccagacaatgaggccacttcaaaaccgttaatgagggatccacccccatgattcaaacacttcccactgggcttcatctccaacactagagatcacatttcaacatgagatttgaaggggacaaacatccagactatatcgtaagaaatggaaacccttgaa

SEQ ID NO: 877 - DNA, 5255 bp, Homo sapiens
gagcagcactgaattattcataggccaatgtattgcaagttttagagggaattttcttcaaggttgtggctgtgaggctgcagagtgaaaggagtaatgaatatgcctaacactcacagaggtgagaaatgctgcctggactcacacagcccagggtctcaggctcacgcagccctgggacaatcacagtgaagagaaatgccctgaatagagaatcacactgtcttggccttggtggatggaaccctaatctctctgaactcttcaatctgtgggttgatggattaaacacacatgtattcaacataaatggatagctgggtctcctcgaactctacacctgtatggaatccatttcctcttgttctggaccatttagaagggcacgtgggtaactggagctgtctgacagacatactggctggagaagcggtgaggtccccaatactgaaatggtttgggttggaaatgatgagtaaccatcaggcatgctgtgggaggggctcctgctctgggtggagatgggactggatgtctgtggatgatcaaagccatcttgttaatcaatttgagggtcaagatcatcctcacatctgagtatcttgaaaggttcctcacaaatctaagattcaactactaggaataatggtctcaaagtagaatctgaacatggattcccttagactcaaaactggaatctgaacttggattcccttagactcacaactgtttggctttgtcaggtgttgcttcttggatttgcctcctgactgttgccaatcccctccctacctcatagtcttcattcatcccctgcagtgccccactgatgacaccattctgccagtgacgcctggatctcccatggcatcgtaggtagctttacggagaggaagtgtagcctcatggagaaaccagcaactctggagcaggaggacttacttagattaatatcttgatttcaccattatggctgggtgactttggccaaatcaacaaacctctctgaccttcactgtcctgttccacaaaatgaaaatagtaacaaccattttttataggattgtgaggcttatgtgaaataatggaaataaggcacttggccaggcgtggtggctcatgcctgtaatcccagcactttgggaggcagaggcgggcggatcacctgaggtcaggagttcaagaccagcctggccaacatggcaaaactgcatctctacgaaaaatacaaaacttagctgggcatggtgatgcgtgcctgtaatcccagctacttgggaggctgagagagaagaattgcttgaacccaggaggcggaggttgtagtgagtcaagatcgcaccactgcactccagcctgggcaacagagcaagattctgtcaaaaaaaaaaaaaaaaaaagaaagaaaagaaaagaaaagaaaagaaagaaagaaagaaaagaaggcacttgatataatgcttagcacatccctccccagcttcattgttctcttgtgtctcttgcccttgaccatgcaattccatagaccattattcccctcctgggacagagatttctaattgcccactagtgcccatctccccttcttccctcttagttttagttagatacatggctacttagttagacactatagattccagcctccctttcagccaggagttgccacatgactaagctctggccagaggaatgatgcaagcaaaagtgacgtgtgcagcttcttcaagaagaaattgtttgccttccataatttccatctttcttcctggaatgtgggagtggtgctggtctgttagctttgatcatgcaaatgaggaaaacaccctagaaaatggcaatgggccccagacaacctcttgacatgggactatcttcccagcctggaccattcacctacctatagattagtatgcaagagaaaagcctcttctcagcctctgctcattctcccaccttgacttagatgtcacttcaccatctctgaccctccaagaccagcgcttcctatgagccttcactcatgccctcatgtctgcaagccccacaagactaggagcaccatgaggaagggaccatggtctcatctgcgcaggttttctcaggaacaggaatacagtaggcacttagtaaatgttgaataaatcgatgatagtgccacacgcttacaaactgccttagttcttgcctaaagggatcgtaagcacgtccacctgcttaatctccagcaaaaacaaaagaacaattcccattttttttttctcccttcctccaaacacgcccagggctttcttccatgaccagttggccagagcagaccctggaaagaagccttccccaaggggccttgttgactatggccaaggcctggcccagtgctggacaccagtctatgtgagtatatttctgtaagtccatagttattagcagaatcccaccccagtgtgagacctggtagtatgtgaccaggtccatgaagtgtagtagcagttgtccccactagactatttttgcctggaaaacctaggcaaaaacagaggctttggttaaaaaaaaaacaggggtggggtggggagaggattcacagatcaaatgtaattggaaaaggcatgcaaactttttcaatttatacacagctacagaggtctatttacagatctgggatggggttgggcttaatggctcatgcctgtaatcccagcactttgggtggctgaggtgggaggatcgcttgagcccagaaagttgaggctgcagtgaaccatagttgcaccactgcactccagcctgggtgacagagtgagaccctgtctcaaaacaaacaaacaaacaaacaaacaaacaaacaaacaaacgaatctgggatggagcagtcctggtggacttctctggtcattgtgtagaaggcgctatgcagcctacaaggaccaaggtcttgcagccaactctgaaagccagggctctggctcccagccagcctttccttgaagacatttcttgagcgcattgcccttggcagcagttagatgctgctgctttttattagtgcttccttctgtttttccaggccctcttttggggttctttctgcagacagtggctttcgttttaacctgagggtttagaagaggacagtgggctggcctcaccacccatcagcctctgctttggggactgaatgcacaacgtcatccacactcctaaactgacctccaaatacacacagttgtgatctcactgctcaggagggctggaaaccatggcagctctcctgagggctcagtggggccagccaccctcagctggaggtgtaagcagattttttttttaattgagaaggagtctcactctgttgcccagggtggagtgtagtggtgtgatctcagctcactgcaacctctgcctcccgagttcaagcaattctcctgcctcagcctcccaagtagctgggattataggtgcctgcctaatcccatgcccagctaattttattgtatttttagtagagatgtggtttcaccatgttagccaggctagttaggaacttctgacctcaagtgatctgcccgcctcggcctcccaaagtgctgggattacaggcgtgagccaccgtgcccggccgtgtaagcagatttttgtgggtgaagtttgccccagagcaggagctctctgtcctgttgcctaagaagagtaagactggtgcttttgagaaaaagcaaagtgccaactcagggggagaagcttcagacctcctatttgactcaggcatgccctctactgcaaccaggtaattatggtggtttaactgtccttgatggtagaaccagaagctctcacatttgcggagacctttgatagtggtgctgttctccgcagtcctgtctttgatgggtcatctcatatttcctccccagtagagcacagggtgagatggggcaggaggggaggtcaccttcaaagagtcccatcaaacaggggaatcttgggggccactaataccctctgcttacattagccaatgttgatgcaaggttaccttcaaagttcgtgttcatcttacttaaacctgttcaggtaacaaagcccttgaagtcttgaatttatgtggtcttagactttaaagttcttgagaaaaaaataccataggggaaaatctaaaagtaagacagctttatgctttgacttaattttgtctgtgaattgaaaaggaacatgcctttattcagctttgggaaggagggacaactcgggagcttaattaaatgtcactgatcccaccctagtggactgttaggctttgtgatctgggttgaacatggacacccccagtcagcctctctgcatcccttccagaacattctttctgagggtgaaactagaagtaatagtttagcttgtggttacctttatttcaacatagctcaacttttagaatcacctacttaaaagtaatgatgaaattaataataaaagttatttgttgcagggcatggtggctcacacatctaatcccagtgctttgggtttagatggtgggcggatcacctgagatcaggagtttgagaccagcctggccaacgtggtgaaactgtctctactaaaaatacaaaaattagctgggtgaggtggcgcatgctgtaatcccagctactctggagattgaggcaggagagtcacttgaatctgaaaggcggaggttgcagtgagccaagatcacaccactgccctccagcctgggtgacaagaacgagactctgtctcaaaaaaaaagctatttattgagcacatagtatgtgccaggcactgtgctattttctctgcatgctttttctcacttagtcctcatgacaacctgtgcagtagataccgttttttgttgttaaaaattttttaggggtagagactgggtcttgctatgttgcccaggctggtcttgaactcctggcctcaagccaccctccttgccttggcctctcaaagtgctgagattacaggagtgagccaccacacccagcctggtaggtatcattatggtccccactttacagatgaggaaaatgaggctcagagaaattatgtgatttgcccaagttgaccaaaaggccagggttttctggatttgatacaattttgcgagagggctgattcttagtgaatggggagaaaccagcttctcccactttgggaaaggttgtgtcctgccatccatgtcagatggtcctaaagaaacactcactaacccttgttctcat

SEQ ID NO: 878 - DNA, 7320 bp, Homo sapiens
ggttcattctttttatgaggaagacttctggtctcttactctgttccttgaatggatttacatcccagaaagatgtgtgctctgtgcaaatgaaggggtgctcttccactgtaaagaatgcattggctttctggactggggggctggctggcacaagcctttcccaggatacagcagtttctgaaagggtttttggagctgcagagtcaaggactgggctgggagtcttggtgaccctaccaagcacagagagtgccaggcgcccgattggagaaagctgtgggagtcttctagaacaatcgtactaactgcacacaccatctgcatgaaccaataccaggttgtattggtattcggccatcttgtgctgtttcctcagggtgtccctagagtgttttgtttttgactagcatttaagcagcctgcaggcagggactgcattttatacacagtgtgtgcctcccaggagccaggtgcagctggggtgtgtgactgtgaggctccttgctgtccatgacatactgtcacccccactgccttagcttactccccagtcaccccttgaggtaacagggctggtgcttttacaattctcattttaaagatgaggaaataggctgggtgtagtggctcatgcctgtaatcccagccctttgggaggccgaggcaggtggatcatttgaggtcaggagttcgagatcagcctgaccaatatggtgaaaccctatctgtactaaaaacacaaaaaaattaccagagtgtggtggtgcacgcctgtaatctcagctactcgggagactgaggcccgagaatcgcttaaacccagaggtggaggttgcagtgagccgagatcacaccagtgcaatccagcctgggtgatagagtgagattctgtttcaaaaaaaaaaaaaaaaaaaaaaaaaaaaaaagatgaggaactagaggtcagtgagtgctggcctcaagagaaccttgaaatcccactctgcctagccctgaccacccttgtcttcaatccttgaggaacagaatgatgccaggtgtaagtcattcaggtatctccccagtacctctacctggggaggagataatgttctcggcctacatggtggggagggtgaccacggtgcggggtgaggggaaggctcttctgccatgccttgggacttccctttctgtgtgagtgtgaggtaggtggattgcgcctactcagcatggattttgcacagaaagtcttgctcgcttttccttggtgtgatttttattgaactcacctttccttactaagggagtgttaagttggtttgggtttcaggagaaaagacacatagcctacttaggtgagccccccagcctacattaaggaatctcttacatgggacagcctggtccacccaggcaaaaattttcagtaataaataatttgcatttgcccaccctatgatgggacaggagtggaggatacggtttctggccagatcccatgatcctgtcctcatccctcaacatgcactagggaccctcccatgctcccactaccacaaaaggcagaattggggctggaacatctgacccaagtccacacctgtttcctctcctcttccgcatttctgagtcttaaagcgatgctgggccaaagtgggggtggtccttggccgtcctgggaggagctttgcacactggctctaagttcctatttcggttgatggttctatagtggatgagctccacactcaattcttatacccctgcagctgccataggaggcagggtgacctgtcaccaaggcagctcccacaacctggtcacagctctttcctcagggcctgttacccagcatgagctaaagtccttgggagcttctaagaccacttgaaggaggaaatttattctgtgtctttccttctctctttctccctccctccctgtcttcttttatctttccttcccttcctttttcctcccatccattcactcaaatctaggcgatgcatccctgtagtgtgctagctattgtttctctaggtgaagaggcatcagaaacagaatacttcccctgagtcaggagcagcactgaattattcataggccaatgtattgcaagttttagagggaattttcttcaaggttgtggctgtgaggctgcagagtgaaaggagtaatgaatatgcctaacactcacagaggtgagaaatgctgcctggactcacacagcccagggtctcaggctcacgcagccctgggacaatcacagtgaagagaaatgccctgaatagagaatcacactgtcttggccttggtggatggaaccctaatctctctgaactcttcaatctgtgggttgatggattaaacacacatgtattcaacataaatggatagctgggtctcctcgaactctacacctgtatggaatccatttcctcttgttctggaccatttagaagggcacgtgggtaactggagctgtctgacagacatactggctggagaagcggtgaggtccccaatactgaaatggtttgggttggaaatgatgagtaaccatcaggcatgctgtgggaggggctcctgctctgggtggagatgggactggatgtctgtggatgatcaaagccatcttgttaatcaatttgagggtcaagatcatcctcacatctgagtatcttgaaaggttcctcacaaatctaagattcaactactaggaataatggtctcaaagtagaatctgaacatggattcccttagactcaaaactggaatctgaacttggattcccttagactcacaactgtttggctttgtcaggtgttgcttcttggatttgcctcctgactgttgccaatcccctccctacctcatagtcttcattcatcccctgcagtgccccactgatgacaccattctgccagtgacgcctggatctcccatggcatcgtaggtagctttacggagaggaagtgtagcctcatggagaaaccagcaactctggagcaggaggacttacttagattaatatcttgatttcaccattatggctgggtgactttggccaaatcaacaaacctctctgaccttcactgtcctgttccacaaaatgaaaatagtaacaaccattttttataggattgtgaggcttatgtgaaataatggaaataaggcacttggccaggcgtggtggctcatgcctgtaatcccagcactttgggaggcagaggcgggcggatcacctgaggtcaggagttcaagaccagcctggccaacatggcaaaactgcatctctacgaaaaatacaaaacttagctgggcatggtgatgcgtgcctgtaatcccagctacttgggaggctgagagagaagaattgcttgaacccaggaggcggaggttgtagtgagtcaagatcgcaccactgcactccagcctgggcaacagagcaagattctgtcaaaaaaaaaaaaaaaaaaagaaagaaaagaaaagaaaagaaaagaaagaaagaaagaaaagaaggcacttgatataatgcttagcacatccctccccagcttcattgttctcttgtgtctcttgcccttgaccatgcaattccatagaccattattcccctcctgggacagagatttctaattgcccactagtgcccatctccccttcttccctcttagttttagttagatacatggctacttagttagacactatagattccagcctccctttcagccaggagttgccacatgactaagctctggccagaggaatgatgcaagcaaaagtgacgtgtgcagcttcttcaagaagaaattgtttgccttccataatttccatctttcttcctggaatgtgggagtggtgctggtctgttagctttgatcatgcaaatgaggaaaacaccctagaaaatggcaatgggccccagacaacctcttgacatgggactatcttcccagcctggaccattcacctacctatagattagtatgcaagagaaaagcctcttctcagcctctgctcattctcccaccttgacttagatgtcacttcaccatctctgaccctccaagaccagcgcttcctatgagccttcactcatgccctcatgtctgcaagccccacaagactaggagcaccatgaggaagggaccatggtctcatctgcgcaggttttctcaggaacaggaatacagtaggcacttagtaaatgttgaataaatcgatgatagtgccacacgcttacaaactgccttagttcttgcctaaagggatcgtaagcacgtccacctgcttaatctccagcaaaaacaaaagaacaattcccattttttttttctcccttcctccaaacacgcccagggctttcttccatgaccagttggccagagcagaccctggaaagaagccttccccaaggggccttgttgactatggccaaggcctggcccagtgctggacaccagtctatgtgagtatatttctgtaagtccatagttattagcagaatcccaccccagtgtgagacctggtagtatgtgaccaggtccatgaagtgtagtagcagttgtccccactagactatttttgcctggaaaacctaggcaaaaacagaggctttggttaaaaaaaaaacaggggtggggtggggagaggattcacagatcaaatgtaattggaaaaggcatgcaaactttttcaatttatacacagctacagaggtctatttacagatctgggatggggttgggcttaatggctcatgcctgtaatcccagcactttgggtggctgaggtgggaggatcgcttgagcccagaaagttgaggctgcagtgaaccatagttgcaccactgcactccagcctgggtgacagagtgagaccctgtctcaaaacaaacaaacaaacaaacaaacaaacaaacaaacaaacgaatctgggatggagcagtcctggtggacttctctggtcattgtgtagaaggcgctatgcagcctacaaggaccaaggtcttgcagccaactctgaaagccagggctctggctcccagccagcctttccttgaagacatttcttgagcgcattgcccttggcagcagttagatgctgctgctttttattagtgcttccttctgtttttccaggccctcttttggggttctttctgcagacagtggctttcgttttaacctgagggtttagaagaggacagtgggctggcctcaccacccatcagcctctgctttggggactgaatgcacaacgtcatccacactcctaaactgacctccaaatacacacagttgtgatctcactgctcaggagggctggaaaccatggcagctctcctgagggctcagtggggccagccaccctcagctggaggtgtaagcagattttttttttaattgagaaggagtctcactctgttgcccagggtggagtgtagtggtgtgatctcagctcactgcaacctctgcctcccgagttcaagcaattctcctgcctcagcctcccaagtagctgggattataggtgcctgcctaatcccatgcccagctaattttattgtatttttagtagagatgtggtttcaccatgttagccaggctagttaggaacttctgacctcaagtgatctgcccgcctcggcctcccaaagtgctgggattacaggcgtgagccaccgtgcccggccgtgtaagcagatttttgtgggtgaagtttgccccagagcaggagctctctgtcctgttgcctaagaagagtaagactggtgcttttgagaaaaagcaaagtgccaactcagggggagaagcttcagacctcctatttgactcaggcatgccctctactgcaaccaggtaattatggtggtttaactgtccttgatggtagaaccagaagctctcacatttgcggagacctttgatagtggtgctgttctccgcagtcctgtctttgatgggtcatctcatatttcctccccagtagagcacagggtgagatggggcaggaggggaggtcaccttcaaagagtcccatcaaacaggggaatcttgggggccactaataccctctgcttacattagccaatgttgatgcaaggttaccttcaaagttcgtgttcatcttacttaaacctgttcaggtaacaaagcccttgaagtcttgaatttatgtggtcttagactttaaagttcttgagaaaaaaataccataggggaaaatctaaaagtaagacagctttatgctttgacttaattttgtctgtgaattgaaaaggaacatgcctttattcagctttgggaaggagggacaactcgggagcttaattaaatgtcactgatcccaccctagtggactgttaggctttgtgatctgggttgaacatggacacccccagtcagcctctctgcatcccttccagaacattctttctgagggtgaaactagaagtaatagtttagcttgtggttacctttatttcaacatagctcaacttttagaatcacctacttaaaagtaatgatgaaattaataataaaagttatttgttgcagggcatggtggctcacacatctaatcccagtgctttgggtttagatggtgggcggatcacctgagatcaggagtttgagaccagcctggccaacgtggtgaaactgtctctactaaaaatacaaaaattagctgggtgaggtggcgcatgctgtaatcccagctactctggagattgaggcaggagagtcacttgaatctgaaaggcggaggttgcagtgagccaagatcacaccactgccctccagcctgggtgacaagaacgagactctgtctcaaaaaaaaagctatttattgagcacatagtatgtgccaggcactgtgctattttctctgcatgctttttctcacttagtcctcatgacaacctgtgcagtagataccgttttttgttgttaaaaattttttaggggtagagactgggtcttgctatgttgcccaggctggtcttgaactcctggcctcaagccaccctccttgccttggcctctcaaagtgctgagattacaggagtgagccaccacacccagcctggtaggtatcattatggtccccactttacagatgaggaaaatgaggctcagagaaattatgtgatttgcccaagttgaccaaaaggccagggttttctggatttgatacaattttgcgagagggctgattcttagtgaatggggagaaaccagcttctcccactttgggaaaggttgtgtcctgccatccatgtcagatggtcctaaagaaacactcactaacccttgttctcat

SEQ ID NO: 879 - DNA, 10380 bp, Homo sapiens
gagcagcactgaattattcataggccaatgtattgcaagttttagagggaattttcttcaaggttgtggctgtgaggctgcagagtgaaaggagtaatgaatatgcctaacactcacagaggtgagaaatgctgcctggactcacacagcccagggtctcaggctcacgcagccctgggacaatcacagtgaagagaaatgccctgaatagagaatcacactgtcttggccttggtggatggaaccctaatctctctgaactcttcaatctgtgggttgatggattaaacacacatgtattcaacataaatggatagctgggtctcctcgaactctacacctgtatggaatccatttcctcttgttctggaccatttagaagggcacgtgggtaactggagctgtctgacagacatactggctggagaagcggtgaggtccccaatactgaaatggtttgggttggaaatgatgagtaaccatcaggcatgctgtgggaggggctcctgctctgggtggagatgggactggatgtctgtggatgatcaaagccatcttgttaatcaatttgagggtcaagatcatcctcacatctgagtatcttgaaaggttcctcacaaatctaagattcaactactaggaataatggtctcaaagtagaatctgaacatggattcccttagactcaaaactggaatctgaacttggattcccttagactcacaactgtttggctttgtcaggtgttgcttcttggatttgcctcctgactgttgccaatcccctccctacctcatagtcttcattcatcccctgcagtgccccactgatgacaccattctgccagtgacgcctggatctcccatggcatcgtaggtagctttacggagaggaagtgtagcctcatggagaaaccagcaactctggagcaggaggacttacttagattaatatcttgatttcaccattatggctgggtgactttggccaaatcaacaaacctctctgaccttcactgtcctgttccacaaaatgaaaatagtaacaaccattttttataggattgtgaggcttatgtgaaataatggaaataaggcacttggccaggcgtggtggctcatgcctgtaatcccagcactttgggaggcagaggcgggcggatcacctgaggtcaggagttcaagaccagcctggccaacatggcaaaactgcatctctacgaaaaatacaaaacttagctgggcatggtgatgcgtgcctgtaatcccagctacttgggaggctgagagagaagaattgcttgaacccaggaggcggaggttgtagtgagtcaagatcgcaccactgcactccagcctgggcaacagagcaagattctgtcaaaaaaaaaaaaaaaaaaagaaagaaaagaaaagaaaagaaaagaaagaaagaaagaaaagaaggcacttgatataatgcttagcacatccctccccagcttcattgttctcttgtgtctcttgcccttgaccatgcaattccatagaccattattcccctcctgggacagagatttctaattgcccactagtgcccatctccccttcttccctcttagttttagttagatacatggctacttagttagacactatagattccagcctccctttcagccaggagttgccacatgactaagctctggccagaggaatgatgcaagcaaaagtgacgtgtgcagcttcttcaagaagaaattgtttgccttccataatttccatctttcttcctggaatgtgggagtggtgctggtctgttagctttgatcatgcaaatgaggaaaacaccctagaaaatggcaatgggccccagacaacctcttgacatgggactatcttcccagcctggaccattcacctacctatagattagtatgcaagagaaaagcctcttctcagcctctgctcattctcccaccttgacttagatgtcacttcaccatctctgaccctccaagaccagcgcttcctatgagccttcactcatgccctcatgtctgcaagccccacaagactaggagcaccatgaggaagggaccatggtctcatctgcgcaggttttctcaggaacaggaatacagtaggcacttagtaaatgttgaataaatcgatgatagtgccacacgcttacaaactgccttagttcttgcctaaagggatcgtaagcacgtccacctgcttaatctccagcaaaaacaaaagaacaattcccattttttttttctcccttcctccaaacacgcccagggctttcttccatgaccagttggccagagcagaccctggaaagaagccttccccaaggggccttgttgactatggccaaggcctggcccagtgctggacaccagtctatgtgagtatatttctgtaagtccatagttattagcagaatcccaccccagtgtgagacctggtagtatgtgaccaggtccatgaagtgtagtagcagttgtccccactagactatttttgcctggaaaacctaggcaaaaacagaggctttggttaaaaaaaaaacaggggtggggtggggagaggattcacagatcaaatgtaattggaaaaggcatgcaaactttttcaatttatacacagctacagaggtctatttacagatctgggatggggttgggcttaatggctcatgcctgtaatcccagcactttgggtggctgaggtgggaggatcgcttgagcccagaaagttgaggctgcagtgaaccatagttgcaccactgcactccagcctgggtgacagagtgagaccctgtctcaaaacaaacaaacaaacaaacaaacaaacaaacaaacaaacgaatctgggatggagcagtcctggtggacttctctggtcattgtgtagaaggcgctatgcagcctacaaggaccaaggtcttgcagccaactctgaaagccagggctctggctcccagccagcctttccttgaagacatttcttgagcgcattgcccttggcagcagttagatgctgctgctttttattagtgcttccttctgtttttccaggccctcttttggggttctttctgcagacagtggctttcgttttaacctgagggtttagaagaggacagtgggctggcctcaccacccatcagcctctgctttggggactgaatgcacaacgtcatccacactcctaaactgacctccaaatacacacagttgtgatctcactgctcaggagggctggaaaccatggcagctctcctgagggctcagtggggccagccaccctcagctggaggtgtaagcagattttttttttaattgagaaggagtctcactctgttgcccagggtggagtgtagtggtgtgatctcagctcactgcaacctctgcctcccgagttcaagcaattctcctgcctcagcctcccaagtagctgggattataggtgcctgcctaatcccatgcccagctaattttattgtatttttagtagagatgtggtttcaccatgttagccaggctagttaggaacttctgacctcaagtgatctgcccgcctcggcctcccaaagtgctgggattacaggcgtgagccaccgtgcccggccgtgtaagcagatttttgtgggtgaagtttgccccagagcaggagctctctgtcctgttgcctaagaagagtaagactggtgcttttgagaaaaagcaaagtgccaactcagggggagaagcttcagacctcctatttgactcaggcatgccctctactgcaaccaggtaattatggtggtttaactgtccttgatggtagaaccagaagctctcacatttgcggagacctttgatagtggtgctgttctccgcagtcctgtctttgatgggtcatctcatatttcctccccagtagagcacagggtgagatggggcaggaggggaggtcaccttcaaagagtcccatcaaacaggggaatcttgggggccactaataccctctgcttacattagccaatgttgatgcaaggttaccttcaaagttcgtgttcatcttacttaaacctgttcaggtaacaaagcccttgaagtcttgaatttatgtggtcttagactttaaagttcttgagaaaaaaataccataggggaaaatctaaaagtaagacagctttatgctttgacttaattttgtctgtgaattgaaaaggaacatgcctttattcagctttgggaaggagggacaactcgggagcttaattaaatgtcactgatcccaccctagtggactgttaggctttgtgatctgggttgaacatggacacccccagtcagcctctctgcatcccttccagaacattctttctgagggtgaaactagaagtaatagtttagcttgtggttacctttatttcaacatagctcaacttttagaatcacctacttaaaagtaatgatgaaattaataataaaagttatttgttgcagggcatggtggctcacacatctaatcccagtgctttgggtttagatggtgggcggatcacctgagatcaggagtttgagaccagcctggccaacgtggtgaaactgtctctactaaaaatacaaaaattagctgggtgaggtggcgcatgctgtaatcccagctactctggagattgaggcaggagagtcacttgaatctgaaaggcggaggttgcagtgagccaagatcacaccactgccctccagcctgggtgacaagaacgagactctgtctcaaaaaaaaagctatttattgagcacatagtatgtgccaggcactgtgctattttctctgcatgctttttctcacttagtcctcatgacaacctgtgcagtagataccgttttttgttgttaaaaattttttaggggtagagactgggtcttgctatgttgcccaggctggtcttgaactcctggcctcaagccaccctccttgccttggcctctcaaagtgctgagattacaggagtgagccaccacacccagcctggtaggtatcattatggtccccactttacagatgaggaaaatgaggctcagagaaattatgtgatttgcccaagttgaccaaaaggccagggttttctggatttgatacaattttgcgagagggctgattcttagtgaatggggagaaaccagcttctcccactttgggaaaggttgtgtcctgccatccatgtcagatggtcctaaagaaacactcactaacccttgttctcatgtgtagagaaggatcagaacaggaattagataaagaaagacataacaaaagggagtgtctgaattttttccttttgtccaatgcaagtctggttttgcaactgaaaaatcctaatcaatctcaaagttaaaaactccagaaatgttatctcctggtgacttgtctacagcctcttctaccaggtacaatgatttggtaggctggcttcccgaaggctgtcacctgtgtagtcacgcagggccctgagtttagaagggcccacccttgctttaatgttctgctgtccatttgaaattcttaataatttttaaatgagagaccatgcattttcattttgccctgggcactgcaagttctgtagctgatcctgcaatttaggaaactaaaaataatgcgatgtaacctagaatagctgcagccatgagctactccagaaccaaagctggggtgcctggggtccttcccttgtgtattctgtttgtgtggagagtaagtgaccacacaaggaggttgtctattcacttgccctgcagtgagaactggtattgacatcagagcaggagctcggcaatgaacccatcagaagagtccagcggaatagagatggtgggagccctaggcctatttgaaaatcccaggagaacaaggacaggtggctcaagattccctgagtttggatttgcttgatgccctgactggtggcagagggtctaatttcaatgcatctgacattaatatatccttctgatcccaggcgggagctcagagccttcagtaccccatttcgtttagttttgtttttgagacaggatcttgctctgttgcccaggctggagtggagtggcataatcacggctcactgtaccctcaaactcctgggctgaagcaatcttcctgcttcagccttccgagtagctaggactagaggtgcatctcaccatgcccagctaattttttatttttgatagagatgaggtctcactactttgcctgggccgatcttgaactgcaggcctcatgtgatcctcctgccttgaccttccaaagtgtagggattacaagagtgagccatcatgcctggcaacatttttttgtttttttttttgaggtggagtctcactctgtcacccaggctggagtgcaatggcgcgatcttagctcgctgcaacctccgtctcccaggttcaagcaattctcctgcctcggcctcccgagtagctgggattacaggcgtgagccaccacacccagctaatttttatttttagtagggacggggtttcaccatgttgtccaggctggtctcgaactcctgatctcaggtgatctccctgccttggcctcccaaagtgctgggattacaggcgtgagccaccacacccagctgcctggcaacattttgatttataaatagtttgtcccatcacaagacaatggcagcccattgaaaaacccatgtctttctttgttggtggtttcttatactttctctctcctctctcctctttccttccttccttctttttttttttgaaacggcgtcttgctccgtcgccaggctggagtgcaatggtgcaatcttggctcactgcaacctccgcctcctgggttaaagtgattctcctgcctcagcctcccaagtagctgggattacaggcatgtgccaccatgcccggctagttttttgtatttttagcagagatggggtttcaccatgttagccaggatggtctggaactcctgaccttgtgatccccccgcctcagcctcccaaagtgctgagactacaggcatgagacaccacgcccggccctttctttccttcccttccttctcctccctccctcccttccttccttgctttttctttctttattccttccttccttcctttttctttctttattccttcctttctttctttttctttctttattccttccttccttcctttctctaatttatttatttcttttctttctttctttcttttccttctttctttctttctttccttccttccttctctcttttcttctgtctttctttctctctctctttctcttcctttccttgccttgccttctttccttcctttctttcttttgagatggagtcttactctgtcactcaggctggagtgcagtggtgcgatcttggcttactgcaaccttcacttcccgggttgaagcaattctcccacctcagcctcctgagtagctgggattacagatgtgtgccaccatgcttggctaatttttgtatttttagtagtatttagatttagttgtatttgccacgttggccatgctggtctcaaactcctggcctcaagtgatccgcacacctcggcctcccaaagtgctgggattacaggcatgggccaccgcacctggccaaaagatctttcaaggagaaagaaagtccaagctgctctgaaccatttggcttctgtgttgtaataaaggtttataaatcatcattgttgggcatccatagacatatattcactgcttccttggtctacttggtctcctgaccgctgtcccagaatttggggtgttagcccccaggctgccttactgccaaagcagaattctggcatccctggctgctctgtgctgtttctatactgtctgcccccagggcccctctctggctggctctgatctggcagcctgctcattgctctgcgttgtcatggagaaggttttagaaacatattgttgaactgtgggtgtatttctgccacctggtaacaagtgggtttgtagaaaagccacaatggaggaaaagaaagggctcttggaggacagagctagtgccagggaagccagccgcggcagagggatgggagcctgcactgctgtttgctgtttggtattctgtgcaggcagcagcttgctggttgccttggttcctgcaggactcctgggagcttgtggcagacggaaggccatagcctctgccgaagtttacagattctagggaaatgaactgccgtgcagcccaatctgtgggaggagaccaagtgggctctcaaccatttagatgctctgatgtaaatttatgcttcatgcagacagaaaagctgccctctgcttatgtatgccatcaggctgcccttgacccatctgtgccagctcctcatggggcctagatgtcctagccacctggacaccccctctaccctcccacacctagttcctgcaaggacttcagacagccaatttagggcacctgccacaccactgtctgcagctttgtaggtcaaaaacagttgaatattgacaatttcatattgttcaacctaattgaaagctttggggtgacttgacactttcatcaggcttagataagatcattaaagaaaatcattaatagattttctcttgcctgatacaatcttttcccttctaaattattctaaatcctggtactctgtgtccacgtcgtcttcatcttccaaatgatgtatatgctactaattatgccctgaaagctacagagcatacgccttttccttgagaaggtttgtatactctttctactccttgaggtagaggctagatccattcccatgcccatatagagaaaaggtatcttctaatggactccaaagatgtgttaattggtttgatcacaagcacaagaaactatatatttgtattacttgtacattcttttttaatatagtacaatgtttatttaaaatctgagctgggccaggcatggtggctcatgcttttcatcccagcactttgaaggctgaggtgggcagatcacctgagcctaggaattagagatcagcctaggcaatgtggcaaaactccacctttacaaaaaatttaaaaattagccaggtgtagtagcatgagcctatagtcccagctacttgggaggctgatgtgggaggatcacctgagcccggagaagtttaggctgcagtgagccaagatcacgccactggactccagcctgggcaacagagtgtgagaccctgtctcaaaaaaacaaaacaaaacaaaaaatctgatctgccaacttagcatttttccaccaactcggggagctgaaactttcccaggcttcacaatcttttgcttaggggacgcccttgtggatctttttcgatgcttgcttagcctattttgcttccttagcagccctgcgagcttgttctcgttgagcctctttaacttcaaatttctgattcctcttggccattagatcagcaagagatgcatcactaatggccccctggaatctgactgcttggcagtttcttttcttctgaatttcttccaaatgtccctttttgtgctttcttctgtagaggacaatccggtttatctactaacggtccctcttggaaaggaaagctgacgtgtactttacgttaagaaactggaaaacctccctgtccgtcctggtgtagcgccttccatgtctagggtagaccttgtacccgcttaaactgtacaacttgaccttcatggtggcagctccaggggaaaagaaaagatggcaaagggaaggagaggatcatgggaagagccattcttcttatgagaagttttggcaacttttgaaaagtctgtgcttacccttatctatgtacatatgacatctacagactatgaacgcattttgcatcaggacctaaatagcaactatcaggttctgaggcatctgccctctccttcctcctccctggatcttgattcagctgctttaagatggctctagtgacgggcctcttatttttctgttgaggcatgggcttatttagctatcctcagccccttgagatatatatcccgcctgaatttttctgtctgtggcatcagactagtatttcccagcctctccctttttatttccttacttcgatgctctcactgcattctctccttttttgaacataaagatgctttcacttattttaatgacctcttgtaaaccagccctttcccttcccagaggtttttgcacacttccctccctgctttctttgtttccacttcttctagtggctgtaagaagtgggattccaggcagaactctagacccacctagggcagcagaggcagactgtgaaacccaggcccacagcttttggctga

SEQ ID NO: 880 - DNA, 4275 bp, Homo sapiens
aactttgacaaataagtgaggcattttttctcatgttttatttttcctgtgaaagttgtataaaatagagttttccttgataatttggtagaatatttctgtaatacaatcttgtatgggtataaagcatgtgtggatgggtgttgggtgtggcagtggtgggcaatgagaagtctctaagtagcatttcagttactgtcatgcttctttatatgtctactatgctaactttggcattttaaatttttccagaagagcgtattcattttgtctaggtttgcaaattacactgacatataattgtgtgcatgtccacataaatgtgtgtatatgtgcacacacacatatatatacacatatatttatatgcacaatgcatatgtctctacatatatattctgatttgactaaacttgttttatttagtttttttgtttgctatcttctttctcttatattgaagaagtttttctagagttgtgtttgcatttcaatcttctccaaaaaatatcctttggatttgcttaaacttattaatcatgccagtcaaattcactatactgaaaaaggtttctaagagttctcatgctattcttcatgctttaccttcagactgtctttacctactttttgtctggcgtactgggtgtatgagagggagctggagttccaacatctttccaagagttaccaccttttcaggagctgatctcagaaaaaaaaagtacagacagggacaggtagaatagctataaaactcgaagatgtttgctatgtcttttggcccattgtgactgctataacaaaatgctataaaatttgggtagattataaataaaaaagaaatcatttctcactcttttggaggctggggagtttaagaaaaaggtgccagagaatttgatgtctggtaaggcctactttctggttcatagatggcaccttctgaattctgtcctcacatggtggcaaggtcccttgggccactttaaaaaggtactaatcccattcatgagggaaccttaccaattatgtaattgcctctcaagggtgttatttcctaataacatcatattgtggttgaggattccagcatatagattttcaggccattgtactatgttaagcgtgcttttactaacaggtaagcactaaactaataatgccttaataattgagatttagtcttctcagttcataaaacgtctggaggacagaatttgctagcaaaggtttaatggttaagtgttatcataactctaggtcaccatcttatactacctcaatttgtattgtagtaccctttacactcaacctgcaattagcacttactctgtgccaatcttttcttttaaaatagacaattttttttcgcatttaatccttacagaaaaactataaggtagatcttgttatttctccctcagatgagtcaatgggaaataaaaatctttaccaaaaatttccaacaaacttcacgttatttcttattggccaacactgagtcacagcttcttcctttgctagggactggatttttatttcatgaaatcaaaagatctgtgtctataccagaaaaaaaaaaattagggttttgttaccaggcaaaaatgcaagtagaaataatagtctccaaactaaaatctttgtggaagaattgaaattatgggagaaataaatcaaaagttcatagtgggtacaatgagagataacttatgcaaattatatgagccacataattgatattattgatatcattgctattacttagatttaaatacataagtaaataaaatgctttcaatgttttttattttttaaatagaatgaaaagtttttataatagatgaaaacaataaagatgaaaccactataacattaagaattataaaatcttattgtattgaacttattgtctttgaatgtattcaagtgaatttataaataaatacaataagtgaattgcagcacaaaatataatgaaatccaaagatcaagtgcatgttttgaccatcagtattgtgttttggcaggagatatgtagaattgatcattaaaggctttttagaactgttggagaaaaaagtctaaaaaacattttaaactatatactataaagtatgacagttaatgaagttaaagtgtatgtaaaactgtagaaatatactataaaataggacagttaatgaaggtaaagtgtagtaaaactatagaaaacaagaaatagaatttggaaaaataccatgttttgagatatctttgtaaatccatgcaactatatttgtaataaaatttttaacaaaaatatgagcttatggttatgtaagctgtatgggatgaggtttaagattagatcacggtgatgataaaacacaaattgtgcaaagaaacatttaattcattagttatgtgaagcataatatacagtcatggaagttcatacctcttgcagtcaaattttccagcaatccagtgctagcttaagtataaaactattatttctgaagttgctttctaatatattccactcgtaaataacttctattttttatcatcctttttagcatttcatttgtatctcttaatgaaagaaaatgaaaacttttagagccacataattgatatcatttgtatcaattacggtaacatctggtagttagcagtatattcatggacctaagctttctctcttactaaagagtctaacttccctaatggtatatatgtaatttttggtttttctctgtattcagtaccattcccctgatgctgaccgacatgtatagagaacagaatacagtgtatttttattgataaaattcagaatattgatttaatggtagcagagttgtttattaaaaaaaaaataagcacaacagttcccaacaacaagctaccaaccccttgttaattgaaggaaaatacctaagacttacttataaaacctacatacagaattttttgaaaaaaaaattttagttaaaatatgaactcaatgacttctatattattcccatcttttaatactatgttattgcttaattcttactaaattgtgcattcattattaatagaaactataagaattcaaactaataagaagatttttaattgctacaaagacattttaaaataagattaaatccaaagaaatctatattacacatcatagatttgttaaaattgctgatgtttttctgacatttgtatgggtttatgtgcttaagaatcaggtgcgaatcttgataaaaatatacatattcagaatgtaccatttgatattttaaatctttggggataagggtgagagaagattcaacatttttatcaatttctcaagctgattttgatacaccatgaagttttataagaactgatacaattttttttctttactatggctgaagggtgtaagtgaattaaggtgagaagtaattttcaatgcactagtctagaactgtacagatgacaaatgatatttcaacagatgaagaaaaaataaactttactatttatagaaaagaatttgatttcactctttgattcaagagtgaaaaacacaataattgaatgcactttgtggtgatggtggagtcttgaggttctgtttttataagtcacaatatttcaaattaaccatacagaaaaaatattgtatttccttatattggccagccagaaagttactggacaatgtcatatacaatatgagtgccaggccagggtccgttaataataaaggagctggtgagtgagacaatttagatggctcaatggggtgtttcagagacagactttgttgaagttatatttagttggcagttataagttagataattaaaattatctaatactgagtcaggtgcggtggctcacacctgtaatcccagcactttggggggctgaggcaggtggatcacttgaggtcaggagttcgagaccagcctggccacatggtgaaaccctgtctctactaaaaatacaaaatttagctgggcatggtggcatgtgcctgtaatcccagctacttgcaaggctgaggctgaggcaggagaattgcttgaacccaggaagcagaggttacaatgagccaagatcacggaactgcactccagactgggtgacagagtatccatctcaaaaaaaaaaaaaaaagaattatctaatactggattcttatgtgataattaccaggttttagaaattttgaaaagtatacaaacacatagaaattcctaagaatagtgactcttcatttgaagaactaatgttttt

SEQ ID NO: 881 - DNA, 26741 bp, Homo sapiens
aactttgacaaataagtgaggcattttttctcatgttttatttttcctgtgaaagttgtataaaatagagttttccttgataatttggtagaatatttctgtaatacaatcttgtatgggtataaagcatgtgtggatgggtgttgggtgtggcagtggtgggcaatgagaagtctctaagtagcatttcagttactgtcatgcttctttatatgtctactatgctaactttggcattttaaatttttccagaagagcgtattcattttgtctaggtttgcaaattacactgacatataattgtgtgcatgtccacataaatgtgtgtatatgtgcacacacacatatatatacacatatatttatatgcacaatgcatatgtctctacatatatattctgatttgactaaacttgttttatttagtttttttgtttgctatcttctttctcttatattgaagaagtttttctagagttgtgtttgcatttcaatcttctccaaaaaatatcctttggatttgcttaaacttattaatcatgccagtcaaattcactatactgaaaaaggtttctaagagttctcatgctattcttcatgctttaccttcagactgtctttacctactttttgtctggcgtactgggtgtatgagagggagctggagttccaacatctttccaagagttaccaccttttcaggagctgatctcagaaaaaaaaagtacagacagggacaggtagaatagctataaaactcgaagatgtttgctatgtcttttggcccattgtgactgctataacaaaatgctataaaatttgggtagattataaataaaaaagaaatcatttctcactcttttggaggctggggagtttaagaaaaaggtgccagagaatttgatgtctggtaaggcctactttctggttcatagatggcaccttctgaattctgtcctcacatggtggcaaggtcccttgggccactttaaaaaggtactaatcccattcatgagggaaccttaccaattatgtaattgcctctcaagggtgttatttcctaataacatcatattgtggttgaggattccagcatatagattttcaggccattgtactatgttaagcgtgcttttactaacaggtaagcactaaactaataatgccttaataattgagatttagtcttctcagttcataaaacgtctggaggacagaatttgctagcaaaggtttaatggttaagtgttatcataactctaggtcaccatcttatactacctcaatttgtattgtagtaccctttacactcaacctgcaattagcacttactctgtgccaatcttttcttttaaaatagacaattttttttcgcatttaatccttacagaaaaactataaggtagatcttgttatttctccctcagatgagtcaatgggaaataaaaatctttaccaaaaatttccaacaaacttcacgttatttcttattggccaacactgagtcacagcttcttcctttgctagggactggatttttatttcatgaaatcaaaagatctgtgtctataccagaaaaaaaaaaattagggttttgttaccaggcaaaaatgcaagtagaaataatagtctccaaactaaaatctttgtggaagaattgaaattatgggagaaataaatcaaaagttcatagtgggtacaatgagagataacttatgcaaattatatgagccacataattgatattattgatatcattgctattacttagatttaaatacataagtaaataaaatgctttcaatgttttttattttttaaatagaatgaaaagtttttataatagatgaaaacaataaagatgaaaccactataacattaagaattataaaatcttattgtattgaacttattgtctttgaatgtattcaagtgaatttataaataaatacaataagtgaattgcagcacaaaatataatgaaatccaaagatcaagtgcatgttttgaccatcagtattgtgttttggcaggagatatgtagaattgatcattaaaggctttttagaactgttggagaaaaaagtctaaaaaacattttaaactatatactataaagtatgacagttaatgaagttaaagtgtatgtaaaactgtagaaatatactataaaataggacagttaatgaaggtaaagtgtagtaaaactatagaaaacaagaaatagaatttggaaaaataccatgttttgagatatctttgtaaatccatgcaactatatttgtaataaaatttttaacaaaaatatgagcttatggttatgtaagctgtatgggatgaggtttaagattagatcacggtgatgataaaacacaaattgtgcaaagaaacatttaattcattagttatgtgaagcataatatacagtcatggaagttcatacctcttgcagtcaaattttccagcaatccagtgctagcttaagtataaaactattatttctgaagttgctttctaatatattccactcgtaaataacttctattttttatcatcctttttagcatttcatttgtatctcttaatgaaagaaaatgaaaacttttagagccacataattgatatcatttgtatcaattacggtaacatctggtagttagcagtatattcatggacctaagctttctctcttactaaagagtctaacttccctaatggtatatatgtaatttttggtttttctctgtattcagtaccattcccctgatgctgaccgacatgtatagagaacagaatacagtgtatttttattgataaaattcagaatattgatttaatggtagcagagttgtttattaaaaaaaaaataagcacaacagttcccaacaacaagctaccaaccccttgttaattgaaggaaaatacctaagacttacttataaaacctacatacagaattttttgaaaaaaaaattttagttaaaatatgaactcaatgacttctatattattcccatcttttaatactatgttattgcttaattcttactaaattgtgcattcattattaatagaaactataagaattcaaactaataagaagatttttaattgctacaaagacattttaaaataagattaaatccaaagaaatctatattacacatcatagatttgttaaaattgctgatgtttttctgacatttgtatgggtttatgtgcttaagaatcaggtgcgaatcttgataaaaatatacatattcagaatgtaccatttgatattttaaatctttggggataagggtgagagaagattcaacatttttatcaatttctcaagctgattttgatacaccatgaagttttataagaactgatacaattttttttctttactatggctgaagggtgtaagtgaattaaggtgagaagtaattttcaatgcactagtctagaactgtacagatgacaaatgatatttcaacagatgaagaaaaaataaactttactatttatagaaaagaatttgatttcactctttgattcaagagtgaaaaacacaataattgaatgcactttgtggtgatggtggagtcttgaggttctgtttttataagtcacaatatttcaaattaaccatacagaaaaaatattgtatttccttatattggccagccagaaagttactggacaatgtcatatacaatatgagtgccaggccagggtccgttaataataaaggagctggtgagtgagacaatttagatggctcaatggggtgtttcagagacagactttgttgaagttatatttagttggcagttataagttagataattaaaattatctaatactgagtcaggtgcggtggctcacacctgtaatcccagcactttggggggctgaggcaggtggatcacttgaggtcaggagttcgagaccagcctggccacatggtgaaaccctgtctctactaaaaatacaaaatttagctgggcatggtggcatgtgcctgtaatcccagctacttgcaaggctgaggctgaggcaggagaattgcttgaacccaggaagcagaggttacaatgagccaagatcacggaactgcactccagactgggtgacagagtatccatctcaaaaaaaaaaaaaaaagaattatctaatactggattcttatgtgataattaccaggttttagaaattttgaaaagtatacaaacacatagaaattcctaagaatagtgactcttcatttgaagaactaatgtttttcctttagagtctatgaatgggctaagtgttgctgttcaaacgattaggattatttcactagtatttagaagccttcaagtcagaaaccaaagaagagctgctactgaaaagatatcattaagtaatcatccacatctctcccaacctatcacccttctaagtatccattgtctaacatccctctctctatgtccatgtgtacgcatttcttagctcacatttatgaatgagaacatgcagtgtttggctttctgtgcctggtttgtttcagttaataactgctagttccatccatgttgctacaaaagacatgatttcattcttttttaaggctgaatactactttgttgtgtatatataccacattttctttacccaattatccatggatagacactgaattttccatatatttgctatcacgaataatgttgtggtaaacatagagcacaggtgtgatatatttttgatatattgatttcctttggatagatactctgtagtggattgaatagtagtactatatttagttctttgagaaatctctatactgttttgtatagagtttgtactaatttaaattcccaccatcagtgtgtaagtgtattctttcctccaccatttcctccattttctcaccaacaggatatttttagtctttttaataatagccatttttttccaagatagaagattagaggcttttaacatgcctcagccacttgtaaataccaagataatgcattaagataaactctgttagctttaacacaagaagaaaaatgggaatccactgaaatcatgaaggacacttcagatcctggggaagaaaatgagggtaaacagccccatgtgagtgtccagctgataaaagtgagtgaaaccataatacatgagagaggcagagagcttcattctgtgactcagctttccacaggggttatgagcaaccaggctgaagcagagcaatttgtttctcccgtgcactgtaactaacatgtggagaggcttggaggtgtgggaagaaaagacactgggaaaagtagccggcattttcccagatctgggactgacagcaggaagccttttattccaggtgcatatgaagccatttttaatccagtggcatataaagctattctttggagacctagcagtatggccatccatgcaagcatttcagtcttgggccagagattggagtgcttgctctagaatgggttagaaacttctacagccagaactgtggcaagcaccccagcagtaggcactgaaattgtgctctctcctgccacaggcctggggtgagaggaaagctgtcacagtgacagtttcctctgggcaacaagacttgcatccagggccagcttggtgacctggaaatggtgtttgtgtgcccttgctgcatgccccagtctgcttccctgagattatgttgtagtgggattctctctgctccacctaagagcactcactcccatggaccagcaatctgaggcaccccacccttcatgaagcagagatcatagtacagcagggccctctcctctctacacccaggcaaaactccaggcattcagaacatctgttcatcttccttctgcatagattgtgatgcagtgagaccctctctgttccacaaccaggcaggtctacaaatttggagcacccatttgtatggattagcaaactgaggtgccccactattactatgcagagatcctggggcaagctgaccttctccacttcatgcccaggcagatctagagacattcagagcaactgtttgcctggttaagcagcttcagacacgccacacatcctgggaatggatggtggtacagtgaggcccttttcactccacacacaggcagctctccaggcatttggagtacctgctcgcctggatcagcagcctgaatgatcctacccttcctgcacagtgattgtggtgcaggtggacatctctgcttcatgcccaggcaaaactccaggtattcaaaggacctgcttgcccagcttgagctgccatgcccttcctgtgcagaaatcctgtacctctctaattcaaacccaggctgacttccaggcattcagagcacctactttcttggctcagcatcctgagctaccccacccttcttatgtaaagatcgtagtgtagcggggccctctccggtccatgcccaggaaaatctctcggcattttgagcacaaatttacctggattaccagcctgagttgcagtacccttcttgtgcagggattgtgctgtagggcgtagctctatactccatgcccaggctaatcgctagacatctagagtacctattctcttgaattagaaatttatgccactcccaccctcagtgcagaaaacttgaggccaaagaggtttccaaggtccgtgcctaggcaaacctctgggcacctggtggtcaaacactggatgcttctgcctgctaataggggacctgtaggaggatctgtccagcctggcccccgtcatctttcccatcccaacccccggaggctgatcagggaggtgaaactatgtgtactccacagatgagctcattgcttgaggcaacagagaacttctcaaagtaaacgagaatgaagtatattcgcagccacagcagccaaaaccggctcttacctatccacgccatctactggcttgtgggtcaaactgcaagcccaatataaaacctattgacagaagtgcatagggctgcagaggcaaagtgaaaagacccctacccagcactctctacagtcacacccctctaggaggcaggtacagggaaagggaaacaactaatattatagagaaagtaagaaaaaaatcttacctgcatgaaaataattacaaaatttataagtgctagtatctttggattagaaggaaccagtgaaagaatactgacaccacgaaaaacgtcaaagtgatgacaccagaggatcatactggctctccagcaatgatccctaaccataatagaaactcagaaatgaatataaagaattcagtgcatggattgcaaggaaattcaacaatatccaagacaaggttgaaaatcaacgcaaagaaacttctaaagcaatgcaggtaaggaagaaaagataaacatcttgaaaagaaatcagtcagaacttatagaaggagaaacctcactaaaagaatttcaaaatacaattgaaagctttatctaaggactggaccgagcaaaataaataactttagagcttgaagaccagtcttccaaaataacccagtcagacaaaaataaaggaaaaaaggaattttaaaaagtgaacaaagtctttgagaaatatgggaatgtgtaaagtgacaacatatgaattactggcattcctgagagagagaacaaatagtaaatagccaggaaaacctatttgagggaataataccagaaaatttctctttttttagagaagtagacatcctgacacaagaaataaatatggcatctgtgacatactatacaaaatgaacatcaccaaggcatatagtcacaagactgtccaaggtcaatgttaaagactaatctttaaaaagaaaagattaaatcacatacaaagggaactacatcaggctaatagcagactttttatcagaatccttgctaaccaagagagattggaggcttattttaagcatttttaaagaaaggaaattccactcaagaatttcatattccactaatataagcttcgtaagcaaaggtgaaataaaacctttttccaaacaagcaataactaagagaatttattataacaccagccttacaaaagatctttaagggaattctaaacattaaagtgaaagaatgatacctgctaacacaaaaacatacttgattacctatcccacagaccttataaaataaccacacaatggaagctacaaaggaaacatctaacaactccatggtaggaagaaaacctcacatataaatactaaccttgaaactaaacagtgtaaacaccccacttaagaggcatagttccaagttgagtaaaaaacaagacctctccatctgctgttttcaagagacttatctcacacataatgccactcattggatcaaagtaaaggtttggagaaacagctatctcacaaatggacatttaaaaagaccatgggtcactatgcttatactgaacacaatagactttacaccaaaaactgcaaaaaaagacaaagaacagcattacatattgatgaaagttcaattcaacatgaagaccccatacttaaatgagatagttaacctatttagagcatccaccattagagcaacaccattgataaaacaagtactttgagacttagggaaagactaagatatccacgtaataatagtgggaaacttcaaaccccactgagagcattaggtagatcatctaggtagaaaactaaaaactgagttttggaaagaaaatttacacttgaccaattggacctacctaataaacagcaaataataataaacctaataaacagaacccttcacccatcaaccacagaatatataatcttctcatctacacatggaacatactacaaggttggactcatgctcagccacaaatcaagtgtcaataagctgaaaaagaaaaagaaaatcatatcacttgtactgtcagatcacagtggaataaaaacagaaattaataccaagaagatctccccaagccccacaattacataggaattgaacaacttgctcttgaatgacttttggcaaagcaacaaaattaaggtagaaatacaaaaatctttgaaatcgatgaaaacagagacacaatatactgaaatttctgggatgcagcaaaagcaatttaatggggaacgtatatattgcactaaacacctatctcagaagttagaaagatctcaaattaataatatcatacctagaggaactatataaacaagaacaaactaacaccaaacattggttctttgaaaggatgaacaatattgaatgaccactagctagattaacaaaaacaaaacaaaaagaagtttcaaatatgcacaatcagaaacaatggtaacgttacaactcatcccacagatacagattatcagagacttttattaataactctatgcacacaaactagaaagtctagaggaaatggataaatctctgtaagcacataacctctgaagattgaatcagggaaaaattgaatttctgaatagagctatatcaaattgcaaaattgaatcattaatgaaaaacataccaatccataaaagccttgaagcaggtagatttgcagtcaaattctaccagatacacaaagagctgttagtatttctattcaagctattctaaaaaattgaggaggaaatactcctccctaagtcattcaaggaaaccagcattaccctgacactaaagcctgcaaacacataacaaaaagaacaaactacagaacaatgtccttgatgccataacaatcttcaacaaaataatgtcaaaccaaatctaatagcacatgaaaaagttaatttaccacgatcagttagcctttattcctgggatgatgcaagggtggttcaacatatgcaaatcaataaatgtgattaaccatgtgaacagaattaaaacaaaaatcatatgatcatcttaatagatgcataaaagtgtttgatggaatatcccttcatgataaaaattctcaacaaactaggtatcaaatgaacatacatcaaaataattagatatgtcggtgacaaacccacagacaacatcatactgaatgggcaaatgctagaagcattccccttaacaataggaacaagacaaggatgcccactctcaccactcctattcaatatagtgctagaagacttaaccagagcaatcaggtaagagaaagaaataaaagacatccaaataggaaaataataagttaaatatctctcttcactacatttgaaaaaaacaaaaaactattctaaaatttatatggaagaaataacagagcccaactagccaaagcaatcctaaacaaaaagaacaaagttgcctgggcatgatggctcatgactgtaatcccagcactttgggaggctgaagcaggtggatcatgaggtcaggagttcgagaccagcctggccaacatggtgaaaccccgtgtctactaaaaatacaaaaattagctgggcgtggtggcacacacctgtaatcctaactactcaggaggctgaggcaggagaattgcttgaacctgggaggcagaggttgcagtgagctgagatcacgccactgcacaccagcctgggcaagagagcaaaactctgtctcaggaaaaaaaaaaaaaaagaacaaagttggagagatcatattacctgacttcagactatactagaaggctacagtaaccaaaacgtcatggtgtttgtacaaaaacagaaacataaacaaatgcaacagaataaagaacccagaaataaagctgcacacctacagccatctgatcttcgacaaagttgacaaaaataaacagtggagaatggaattcctattttaatggtgctgcgatagctggctagccatatgcagagaactgaaaccagacttttttagtaacagccattctgactagagtgagatatctcattgtggttttaatatgcatttatctgattattagtaatgtggaccatttttttcatataccttttgcccattattgtttcttcttttgaaaacatatctattcatgtgtgttgcccactttctaatggaatcatttgtttcatcttgttgatgttcttgaattgagtttcttgtatatgtggatactagtccaaaggttacttctttatttatgcaactataatgcacagtgaagcattagtattcttaggtttttatttgtacagtccttgaggggtttgagagtacaactttaaaagtgcacaaaattcatcatgatactggtcataataaacacacatcaagtgtgttagcacactatcattagactgtagcaatcctaaacatctgtaacaattttgtaacataaagcataactagaaaacttatttcaaagatctcttagtatatatgactgaagtttctcagccatggatgatactagttttgaatcaaacacttaaattagtttattatgcctcctcttatgtccaggtaaaattagaatgtccaagaatacacatttctttggactgaggagtttttcagaacacagatttttggtgctaagccatgaaagttccattaaaaaggggaaaagttgttaacatgagttacatggtttctagtttctataaatccagaaatgactgtcccctcctcacccactgttaaatacatgtagacttgggcaggaatacaggactttttttgatgtttgatgtacttttgatttcaaagcaattaaatctgaataaagagaacatcaaagggcagattaagtctcttaaaatatttctgaatattgtggggattttctgagcagcctgcttcagaaattctaaaatgtgatgaatgagcaatctagtctcatgctctggaagcctttgaagacttgaggaccaaatagtgggaatagaaatgagcaactttgatcaatgtcaagggacacttctcccctaaaacacacatacaaaggaccacttaattgtacattctagtagctttccttcgacatgatattttgttagcaacttttccttctcacagaaactattacttatactcttgattttttttattatcagcatcagttggcctagcattcaaagaaaggagtagatgctgactaaatatttactagtggatacaaaatagatcacatattgatggtcataaagaagatatgaaacagaaatttcccttctatatatattatattcattaatgtatttgagtcacactggaacaagaaggcacacattatatcaaacatggaggagagatttaattttgtattttattttctattctaagcttactaggacatactactattcactatcttgactaaataattatacttcctgaatcatattacatcagaactttggtgaacaacaatgacataggaattaatagtagacatgaaggtgagtgaattaaataaaaggttattactatattcttataaagtaattaattaaatttttagcattttgttttgttaagattttacatatgatttttttaacatgctactttataatttcattttttaaagcattaagttttaaacatctttgtacatcattaaatattcttttacataaatatttttaggtaactacatagatattcattttataaaattatcatgatttttaaaacatttttcattgctggacctatgggtcatttttatttttattactataataaagaataccgcaaataaaacatttagattttcatgctaattgttgtcttatatagctttctatatataaagccgaggaaccaaataatgcacaaatgtttctggttttgttaaatgggcattcaaacatactatacaaacttactctcccaagtatattgtgcaacagtaccataatataaatgatcattaattatccataatttgtgtaagcttcattttttcttcttacgttagaatggaaaataaagcatattgtatattgatttagctagtgtatcaaggctgttttactagaacaatacatcatgatcatactttctttttgactactttagggattatatttagtttcattcttataaaaatttatagcttaatgaataaatgaacaatgaggtaatgttcttcaaagcatgtccagttttatatcatgattcatcacatataagaactgctatagaaaagataatgctattctagaattgcatatatgacaggttgatttatctttgcattctgtgtgttttgatgtacagactttttaatggcattcattcattaatttcacagggcatgcctcctatatgtatgacaccatagtggttctagaggtatataaaatgaataaaatacagactctgcccttaaggagtttaaaaactagtaggggagagacatgaaaataaatagccatgatacagaatgaaatgttaagtgcccccagagaggtgaaagcatactccaggaaaatgctgatagatgcaattgcttctacagaaggtaaccaggtaaattgacattggttgggactttaaatattgaatagtgttttattctttttcagaacagtcattgttttggcacttttaaaaataatgaaaggcaaatcatatttccatatatgataagtaacactaaaatactcacatttcttaaaatgtcaataatggaagggatctcaaagatcatctagtcctatatgttattaatatcaagacatgaataaaatattttggaaattgaagtatgcttacaacaaaacctcaactatccataatcatgtaataattctgtaagagttctaaccttgacaaatacatttgtctgcttcctagtctatttgttctgggcagcaacttgactttttacagttcatttggagagaaatctttagcaaactacttgggatccttgatttggttaaagctagaggaaattgtggctgaaaaaagaaaaaaaaaaaagacttaataggccaggcgcggtggctcatgcctgtaatcccagcattttgggaggcagaggcaggcagattgcctgaggtcaggagttcgagaccagtctggccagtatggtgaaaccctgtctctactaaaaattaaaaaaaaaaaattagctgagtgtggtggcatgcacctgtaatcccagctactcaggagactgaggcaggggaattgcttgaaccagggaggtggaggttgcagtgagccaagattgcaccactgcactccagcctaggcgccagaatgagactctgtctcaacaaaaaaaaaaaaaaaaaaaaaagaagacttaatatactttcagatgattgtattatctttattgataattaatatttaagttacaataaatttattgattttctttttattggagagtattttcaattgaaaatcagaatattgggatttagtttttattgtttaaataattactagtttgaacttaggaaagtctttagacttttcttgacatatattttctcacccaattatttccaatcccttttaactatatctaaaatatttgctttttttctttgtaaaatcgtgaacaaaatacatatatgatattgatactactagatagaaaggctgtgaagttggctgttggaaactctcatgctcagttctcattacatcaaccatttcaattgtttcagtacatgattttataagacctttctcccactttcccagtgattacggcatcctacaagttattatttttgtcttccatttctatttaatacactggtaaaattctaagccaaaatttaactgttagttcaaactactttttaagggtataattttatgctttatttgccctttaaataaagctacataattgctctagagagaataagaatgcatgtgggatataatataacatgtaccttttctgaacaaggaaaaaaagttgtgcaaattgaagctgtaattactacgtgcaggcgtaaagaaaaaatgattttctagtcactgtattcattcaccttgagtaggaaattatagtttttctaatttaaaaaggtcactttatttttctgagcatttgattggttgaatatcacacacttttactttttgcatgaattgggctgtttgggggttactgtctagaaaatgttgagacatttatttaaatgcagagtatattattgattccagactgtcaactcaaggctaaaatcctgcttgaaacatgagaagtggataaccatgtgcacatgactagtacctaccccatgacagtttcttaagaaccctgtagtagaattaaattatcagaggttatggaaacggctgcttgtgtctagtgagtatcacactggaaggtcattattgaggcagccataatttttattcacaatacacacacaaccaatagtgccaagataattcaagactgaacatcccatccacacaccaacctgtagattcctgccagttcatgcaagtcagggaattaccaaaaataaattttaaaaattagagtatattccagtggatttaattttgaatgaattttttgtcaaaattttcactttatctatcttctatcctttaaaaattgttttgttctgttaaaattgaatttacatatttattgaaaatatttacattatgtattttttactataagtactcttcaatatagttcaaaatatttatttttctgaattatttattaattttaattgacatataaaattatttatctttattgtacacaggacgatgttctgaaatatgtgtacactatgaaatggcttcatatccagtaaatggtcttgatactaaattcagaccaatacaaaaccataacaggaaactattgaccaatatccccaatgaacataaatgctaaatttctcaacaaaatacgagcaaactgaacccaacagcacttccaaaagatgatacactatgatcaagtgggttttataccagggatgcaaggatggttcaataatgcaaatcaataaatgtgatgcaccacataaacagaattaaagacaaaaactatataatcccaatagatacataaagttgataaaattcagcacttattcatcataaaaaatccctcaacaaactggcatagaaataataaagaccatatatggcgaactcacagccaaaatcatactgaaaggtgaaagttgaaagcattccctttagaagctgaaacaagacaaggatgctcatttgcatcgctcctattaagcatagtattgaaagtcctatccagaagaatcaggcaaggaaaagaaataaaacgtatccaaattggaaaacagggcctcaaattatccctgttcactgatgatatggtcttatatcttgaaaaccctaaccattccaccaaaaacctcctagattttgatgaatgaattagtaaagtttcagcatacaaaatgaacatgcaaaatcagtagtatttctatacaccaacaacaatctagctggagcactaaatcaagaatgcaatgcaatttacaatagatgcaaaaataataacaaggaatatatttaaccaagaggaaaactacaaaacactgatgaaagaagtagtaaatgacacaaatgaaaaataatcacatgctcatggatcagaagaactaatatctttaaaatgaccacaatgcccaaagcaatccacagatttaatgtgattgctatcattatactaacatcacatttcacagaagtagaaaaataatcctaaaatgtatatggagccagaaaaggactcagatatccaaagcaaaactaagcataaagcaggctggagacatcacattacctgatataaaattgtactacaaagttacagtaaccaaaaccgcattgtgctggtacaaaaatagatatatagatcaatggaacagaatagagaaaccagaaatagggccacatacttatagtcagctgaagtttgaacaaagtcaacaagaacacacactggggaaaggacaacattttcaataatgatgctgggaaaaatggatttctatatgcagaaaaataaaatgaggcctctgtctttcatcatatacaacaatcaactaagatgtattttaaataattaaatatatgacctaagactataaattaccagaagaaatctagagaaaattattttgaacattggtccaggcaaggaatacagaaccaagacctcaaatgcacaggcaatgaaaacaaaaataaatggaatttaattaaactaaaaatcttttgtgcagcaaataaataatcaacagggtaaagagacaatcctcagaatgggaaaaaatacttgcaaactattcatccaatagaagactaatatccagaatatgcaaggatctcatacaagtcaacaacaacaacaacaaaagaatcccattaaaaaatggtctaaggacacggtaggaatttgtttttaaaaaaagtcacaaaagtccgacaagaatatgaaaaaaagtttgtatcatcactaatcattagtgaaatagaaattaaaaccacagtgaaatatcatcttacccagtaagaatggctattcttaaacagaaaaaataacagtggttagtgaggacgtggagaaaagaaagcacttatacactgttagtggaagagtaaattagtacaacatctatggaaaatttttggagattttgcaaagaactaaaaatagaactaaattcaatcaagcaatcacacaactagctatctatctaaaggaaaataaatcattatataaaaagacaactgcatctacatagttattgtaggactattcacaattgcgaagatatggaaccaatctaagtgcccatcaaatgatgagtgggcaaaggatacacaatgaaacactattcagccataaaaatgaaattatgtcttttgcagcaacatagatgaaactggaagtcattattttaattgaaatacacacagagacaacacgttatcacttataattgagagcttagtaatgtgtacacatacaggtagtatgtgaaataacagacagtggagacttagaagagggtgggtgatgagaaattacttaatgtctataatgtatgctaatcgctgatagacactaaaagccccgacttcaatgctttgcaatatatcaatataacaaaataatacttgtacctcataaagttatacaaatcaaataaaattttaaataagattactgagatcaacataatggagctttactcctaaattttcttctagtagttttaaagtttctggtcttacattcaagtcttgcaattgattttgagttgacttttttatatggcgtgaagtaaggtccgattttattcttttgcatgtagatgtccagttatttcacatttttgaacattctgtccttttcccgtgcatccttggcacttttacaaaaattaattgaccattgatgtgtagctttatcttttggctttatattctgttctattggttaatgtgtctgtttttattggggggaagaggatattttttgccaataccatgttgttttgattataattgctttgtaatacattttgaaatcaatgatatggtttgactatgttcctacccaagtctcatcttgaactgtagttccaataatctccacgtgttctgtaaaggacccagtgggaggtaattggataataggggtggatacctctatgctggtctcatgatagtgagttctcatgcaatctgatgtttttataagaggatttccccccattcccttggcacttctcattgctgctgctatgtaaagaaggacgtgtttgcttacccttctgccaagagtgtaagtttcctgaggcctccccagtcatgctgaactgtggtcaattaaacctctttcctttataaattacccagtctctggtatgtctttaatagcagcatcagaatgaactaatatagtaaattggcaccatgtgtgggggtgctgttgtaaagatacccaaaaatgtgaagtgattttggaagtgggtaataggcagaggtaggaacagtttggagggctcagaagaagacgtgaaaatgtgggaaaggttggaatttcctagagacttgttgaatggctttgaccaaaatgctgatattaatatggacaataagtccagggtgaggtagtctcagatggaggtgaggaacttgttgggaactggagcaaaggtgactcttgttatgctttagcaaagagactgtcagcatttagcccctgccctagagaggtgtggaactgtaaacttgagagatgatttaaggtacctggcagaagaaatttctatgttttctcgttgttcaattccaaagcattcaagagctgacagaacataaaagtttggaaaatttgcagcctgatgatgcaatagaaaagaaaaacccattttctaaggataaattcaagcctgctgcagaaatttgcataagtaatgaggaggcaaatattaattgccaagacaatggggaaaatgtctccagggaatgtcagagaccttcacagcagcccttcccatcacaagcctcaaggccttggagaaaaaacatggtttcctgggctgggtccaggcactcctgctgtgtgcagcctggagaattggtgtcctgtgtcctagctagtccagctatggctaaaaagggtcaagttacagctggggctatggcttcagagggtgtaagccccaagccttggcagcttccacttggtgtttgtcctgtgggtacagagaagagaagaattgaggcttgagaacctccacctagatttcaaaggatggatgggaaggcctggatgtccaagcaggggtatgctgcaaaaggcagaacactcttttgagaacttctactagggcagtgcgaaagggaaatttggctttggacccccacagagtgtccccactgggacactgccagctgtgagaaaagggccagcctcctccagactccagaacggtagatccactgtcagcttgcaccatgagtcgggaaaagctgcagacagtcaatgtcagccatgaaagcagccatgagaggagttgtaccctgcaaaactacatggtcagagctgcccaaagtcctaggagcccacctcttgcatcagcatgtcctggatgtgagatatggagtcaatggagatcattttggaacttaaggtttaatgactgccctattggattttggacttgcatggggcctgtagctcctttattttggccaatttctcccatttggaatgggtgtattcacccaatgcctgtattctcattgtgtctggaaagtaactaacttgcttttgattttacaggctcataggcagaaatgacctacttttctcagatgagactttggatttggacttttgagttaatgctggaatgagctaagactttgggggactgttggaagggcatgattgtgttttaaattgtgaggacataagatttcaaagggtccgagggcagaatgatatagtatagctgtgtcccctccaaaatctcatcttgaactgtggttctccacatattgtgggagagacctggtgggaggtaattgaaacatgggggcggttacctccatgctgttctcatgatagtgagggagttttcatgagatctgatggttttataaggggctttccccccacttcacttggcacatctccttgctgctgtgatgtaaagaagaacatgtttgcatccccttccaccatgattgtaagtttcctgaggcctcccaagccatggtgaatcatgagccaattaaacttattttctttataaatcacccagtctcaggtatgtcttcattagcagtgtgagaacagacaaatacagtcagggagtgtgatgcctttaggttttttcatttttactctagactgctttggctattctggctttttttttggttacataacaattttaggatttttgtttctattcatgtggaaaaaaagattattgaaatatttatagtaaatgctttaaatctgtatatcactttggtatggacattttaacaatattaattcttctcatcctggaacactaaattttttctgtctatttatatatttggaaatgtccttcattaatgttttctagttttgggtgtacagttctttctcctccttggataaatttagtcagaagtattttattttacatgttgtagtcatcacaaatgtttcttttttaaatttctttttcagatactttgttgtcatcatatataaatactactgatttttgtatatttattttgtaccttacaactttactaaatttgttgactggttctgacagttttattgtgtagtcttcagagttttttaaatatgggattctgtcatctgcagatacaaacaatataacttctttcctaattttgataccatttattcattttgttcttgcctgtttgctctaggtagaagttgcagtatcctcttaataagtagtagcaggagtacactttgtcttgttccatattttagatgaaaagctatcaacttttcccttttgagtgtgatgatattagctgtgggtttattatgtatggcttttattgtgttgaggtacttctttttatacttatgttgtttgaagcttttatcaggaaaatatgatacattttattaaatgctttttctgtatctattgagatgttcacatggttttgttcttcatcattcccttaatgtggtgtattacacttattaccttgcatatattgtcgcatccttgcatcgcagggacaagtcccacttgaaaatgattaataatttttaattgtgctgttgaattatgttgtattacagtctacctctcccttcatagttatctattaatatttctttaatatatttgggagctccaattttggattatatatatatatatttataaatgatatattcccttgattaaccccattaacataatataatgaatgaccttctcctcctttcttatagttttggacttcaaatctgttttatctgatataaatatagctattcctgctctctttttgtcttcatttgtacagattattttttccattccttcactttcagtctatgtgcttcccttaacggtggcatatagttgggtcttggctgcattattattattttttaattgattaagttattccttaccttttgattgcataatttaatccatttacattcatggtaattattaattgataaggaattactattttcttgtttatttcagcttgaacaactctctgtagcatttctcgtaaagaaggtctgatggtaatggaccccctcagcttttatttgtctgaaaaagcctttattttccatttctaaataacatttttatttatagtatgcttactttgcagttctatttccctcaacacgttgactacatcatttcattctttcctggcatgtggtatttctactgagaaatctgctgatagccttattggaactcccttacatttgatttatttcttttctcttgctgatttcagaatcttctctttatttttaatttttgatggcttaattatattatgccttggtgtagtcttatttggagttaatctgattaaagatgtttgatttctagccttcttggaactcttcttaaaattgattttttctttcttttctcttgctgctttcaggatcttcctttatctttacttcttgatgatttgattataatatgccttgacgtagtcttatttggagttaatctgattagagatcttggattttcctctagatggatatttttatattttctcatatttgaaaagcattctgctattgtttttaaaaataatctaatactttgctgctctcttcttctttttctattttttaacattatttgaattttattttatttatttattttattttattttattattattatactttaagttctagggtaaatgtgcacaatgtgcaagttagttacatgtgcatacatgtgccatgctggtgtgctgcacccattaactcgtcatttagcattaggtatatctgctaatgctatccctcccccctccccccaccccacaacagtctccagagtgtgatgttccccttcctgtgtccaggtgttctcattgttcaattcccacctatgagtgagaacatgcagtgcttggttttttgtccttgagatagtttactgagaatgatgatttccaatttcatccatgtccctacaaaggacatgaactcatcattttttatggctgcatagtattccatggtggatatgtgccacattttcttaatgcagtctatcattgttggacatttgggttggttccaagtctttgctattgtgattcgtgccacaataaacatacatgtgcatgtgtctttatagcagcatgatttatagtcctttgggtatatacccagtaatgggatggctgggtcaaatggtatttctaattctagatccctgaggaatcgccacactgactgccacaatggttgaactagtttacagtcccaccaacagtgtaaaagtgttcctatgtctccacatcctctccagcacctgttgtttcctgactttttaatgatcgccattctaactggtgtgagatggtatctcattgtggttttgatttgcatttctctgatggccagtgatgatgagcactttttcatgtgttttttggctgcataaatgtcttcttttgcgaagtgtcttttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttgtgttgccattgcttttggtgttttagacatgaagtccttccccatgcctatgtcctgaatggtaatgcctaggttttcttctagggtttttatggttttaggtctaacgtttaagcctttaatccatagcttaccaaccaaaaatgaatccagatggattcacagccgaattctaccagaggtaaaaggaggaactggtaccattccttctgaaactattccaatcaatagaaaaagagagaatcctccctaactcattttatgaggccagcatcatcctgataccaaagccgggcagagacacaaccaaaaaagacaattttagaccaatatccttgatgaacattgatgcaaaaatcctcaataaaatactggcaaaccaaatccagcagcacatcaaaaagtttattcaccatgatcaagtgggtttcatccctgggatgcaaggctggttcaatatacacaaatcaataaatgtaatccggcatataaacagaagcaaagacaaaagccacatgattatctcaatagatgcagaaaaggcctttgacaaaattcaacaatgcttcatgctaaaaactctcaataaattaggtattgatgggacgtatctcaaaataataagagctatctatgacaaacccacagccaatatcatactgaatgggcaaaaactggaagaattccctttgaaaactggcacaagacagggatgccctctctcaccactcctattcaacatagtgttggaagttctggccagggcaattaggcaggagaaggaaataaagggtattcgattaggaaaagaggaagtcaaattgtccctgtttgcagatgacatgattgtatatctagaaaaccccattgtctcagcccaaaatctccttaagctgataagcagcttcagcaaagtctcaggatacaaaatcaatgtacaaaaatcacaggcattcttatacaccaataacagacaaacagagagccaaatcatgagtggactcccattcacaattgtttcaaagagaataaaatacctaggaatccaacttacaagggacgtgaaggacctcttcaaggagaactacaaaccactgctcaacaaaataaaagaggatacaaagaaatggaagatcattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaagaaagctggaggcatcacgttacctgacttcaaactatactacaaggctatagtaaccaaaacagcatggtactggtaccaaaacagagatatagatcaatggaacagaacagagccctcagaaataatgccgcatatttacaacatctgatctttgacaaacctgagaaaaacaagcaatggggaaaggattccctatttaataaatggtgctgggaaaactggctagccatatgtagaaagctgaaactggatcccttccttacatcttatgctctcttcctcttaaactcatataactctaataatttcttttgtgatgctgttccatacattctttattctctctttattctatttcattgttttcctcctctgactgtgtattttcaaataaactgtcattgagttcacagatttctttgtgtgtgtgtgtaaaaaattatattgtttatgctctctattttattttattcattgtattttataggtccataattgcattatttatttattttaatagccttaggagtacaagtggcttttcattacatggatgaatttgttagtggttgtgatggttaatattgagtatcaacttgattggattgaaggatgcaaagtactgatcctgggtgtgtctgtgagagtattgccaaaggagattaacatttgagccagtgggctggggaaggcagacccacacttaatctggtgggcaaaatataatcagctgccagcaaatacaaagcaggcagaaaaacgtgaagcggagagaatggcctagcctcccagccttcatctttcccccatgctggatgcttcctgccctaaaacatcggactctaggtactttggttttgagactcagactggctctccttgctcctcaagcttacagacagtgtattgtgttaccttgtgatcatgtaagttaatacttaataaacttctcatatatagatatagatatcctatatacctatctctctatctatctatagatatctatatctatctatatctatgtatctatctgtctatgtgtctatctatctatctatctatctatctatctatctatctatctacctatcctattagttctgaccctctagggaaccctgactaatacagtggtgaagtctgggatttgagtgaacattgtacgtaatatgcagttttttatctttcacctcctttccagccttcccacttctgattgttcagtgtccagtataccaatctgtatgcctttgtgtaaccataacttagataccatttataagtgagaatatgtagtattgggtttttaatttctgagacacttcacttagaataatggcttgtagttccatcaaaattgctacaatatacattattttattctttcttatgactgagtaggattccatggtgtgtgtgtatgtgtttgtgtgtgtgtaatcaaaaaacaataact

SEQ ID NO: 882 - DNA, 15532 bp, Homo sapiens
aactttgacaaataagtgaggcattttttctcatgttttatttttcctgtgaaagttgtataaaatagagttttccttgataatttggtagaatatttctgtaatacaatcttgtatgggtataaagcatgtgtggatgggtgttgggtgtggcagtggtgggcaatgagaagtctctaagtagcatttcagttactgtcatgcttctttatatgtctactatgctaactttggcattttaaatttttccagaagagcgtattcattttgtctaggtttgcaaattacactgacatataattgtgtgcatgtccacataaatgtgtgtatatgtgcacacacacatatatatacacatatatttatatgcacaatgcatatgtctctacatatatattctgatttgactaaacttgttttatttagtttttttgtttgctatcttctttctcttatattgaagaagtttttctagagttgtgtttgcatttcaatcttctccaaaaaatatcctttggatttgcttaaacttattaatcatgccagtcaaattcactatactgaaaaaggtttctaagagttctcatgctattcttcatgctttaccttcagactgtctttacctactttttgtctggcgtactgggtgtatgagagggagctggagttccaacatctttccaagagttaccaccttttcaggagctgatctcagaaaaaaaaagtacagacagggacaggtagaatagctataaaactcgaagatgtttgctatgtcttttggcccattgtgactgctataacaaaatgctataaaatttgggtagattataaataaaaaagaaatcatttctcactcttttggaggctggggagtttaagaaaaaggtgccagagaatttgatgtctggtaaggcctactttctggttcatagatggcaccttctgaattctgtcctcacatggtggcaaggtcccttgggccactttaaaaaggtactaatcccattcatgagggaaccttaccaattatgtaattgcctctcaagggtgttatttcctaataacatcatattgtggttgaggattccagcatatagattttcaggccattgtactatgttaagcgtgcttttactaacaggtaagcactaaactaataatgccttaataattgagatttagtcttctcagttcataaaacgtctggaggacagaatttgctagcaaaggtttaatggttaagtgttatcataactctaggtcaccatcttatactacctcaatttgtattgtagtaccctttacactcaacctgcaattagcacttactctgtgccaatcttttcttttaaaatagacaattttttttcgcatttaatccttacagaaaaactataaggtagatcttgttatttctccctcagatgagtcaatgggaaataaaaatctttaccaaaaatttccaacaaacttcacgttatttcttattggccaacactgagtcacagcttcttcctttgctagggactggatttttatttcatgaaatcaaaagatctgtgtctataccagaaaaaaaaaaattagggttttgttaccaggcaaaaatgcaagtagaaataatagtctccaaactaaaatctttgtggaagaattgaaattatgggagaaataaatcaaaagttcatagtgggtacaatgagagataacttatgcaaattatatgagccacataattgatattattgatatcattgctattacttagatttaaatacataagtaaataaaatgctttcaatgttttttattttttaaatagaatgaaaagtttttataatagatgaaaacaataaagatgaaaccactataacattaagaattataaaatcttattgtattgaacttattgtctttgaatgtattcaagtgaatttataaataaatacaataagtgaattgcagcacaaaatataatgaaatccaaagatcaagtgcatgttttgaccatcagtattgtgttttggcaggagatatgtagaattgatcattaaaggctttttagaactgttggagaaaaaagtctaaaaaacattttaaactatatactataaagtatgacagttaatgaagttaaagtgtatgtaaaactgtagaaatatactataaaataggacagttaatgaaggtaaagtgtagtaaaactatagaaaacaagaaatagaatttggaaaaataccatgttttgagatatctttgtaaatccatgcaactatatttgtaataaaatttttaacaaaaatatgagcttatggttatgtaagctgtatgggatgaggtttaagattagatcacggtgatgataaaacacaaattgtgcaaagaaacatttaattcattagttatgtgaagcataatatacagtcatggaagttcatacctcttgcagtcaaattttccagcaatccagtgctagcttaagtataaaactattatttctgaagttgctttctaatatattccactcgtaaataacttctattttttatcatcctttttagcatttcatttgtatctcttaatgaaagaaaatgaaaacttttagagccacataattgatatcatttgtatcaattacggtaacatctggtagttagcagtatattcatggacctaagctttctctcttactaaagagtctaacttccctaatggtatatatgtaatttttggtttttctctgtattcagtaccattcccctgatgctgaccgacatgtatagagaacagaatacagtgtatttttattgataaaattcagaatattgatttaatggtagcagagttgtttattaaaaaaaaaataagcacaacagttcccaacaacaagctaccaaccccttgttaattgaaggaaaatacctaagacttacttataaaacctacatacagaattttttgaaaaaaaaattttagttaaaatatgaactcaatgacttctatattattcccatcttttaatactatgttattgcttaattcttactaaattgtgcattcattattaatagaaactataagaattcaaactaataagaagatttttaattgctacaaagacattttaaaataagattaaatccaaagaaatctatattacacatcatagatttgttaaaattgctgatgtttttctgacatttgtatgggtttatgtgcttaagaatcaggtgcgaatcttgataaaaatatacatattcagaatgtaccatttgatattttaaatctttggggataagggtgagagaagattcaacatttttatcaatttctcaagctgattttgatacaccatgaagttttataagaactgatacaattttttttctttactatggctgaagggtgtaagtgaattaaggtgagaagtaattttcaatgcactagtctagaactgtacagatgacaaatgatatttcaacagatgaagaaaaaataaactttactatttatagaaaagaatttgatttcactctttgattcaagagtgaaaaacacaataattgaatgcactttgtggtgatggtggagtcttgaggttctgtttttataagtcacaatatttcaaattaaccatacagaaaaaatattgtatttccttatattggccagccagaaagttactggacaatgtcatatacaatatgagtgccaggccagggtccgttaataataaaggagctggtgagtgagacaatttagatggctcaatggggtgtttcagagacagactttgttgaagttatatttagttggcagttataagttagataattaaaattatctaatactgagtcaggtgcggtggctcacacctgtaatcccagcactttggggggctgaggcaggtggatcacttgaggtcaggagttcgagaccagcctggccacatggtgaaaccctgtctctactaaaaatacaaaatttagctgggcatggtggcatgtgcctgtaatcccagctacttgcaaggctgaggctgaggcaggagaattgcttgaacccaggaagcagaggttacaatgagccaagatcacggaactgcactccagactgggtgacagagtatccatctcaaaaaaaaaaaaaaaagaattatctaatactggattcttatgtgataattaccaggttttagaaattttgaaaagtatacaaacacatagaaattcctaagaatagtgactcttcatttgaagaactaatgtttttcctttagagtctatgaatgggctaagtgttgctgttcaaacgattaggattatttcactagtatttagaagccttcaagtcagaaaccaaagaagagctgctactgaaaagatatcattaagtaatcatccacatctctcccaacctatcacccttctaagtatccattgtctaacatccctctctctatgtccatgtgtacgcatttcttagctcacatttatgaatgagaacatgcagtgtttggctttctgtgcctggtttgtttcagttaataactgctagttccatccatgttgctacaaaagacatgatttcattcttttttaaggctgaatactactttgttgtgtatatataccacattttctttacccaattatccatggatagacactgaattttccatatatttgctatcacgaataatgttgtggtaaacatagagcacaggtgtgatatatttttgatatattgatttcctttggatagatactctgtagtggattgaatagtagtactatatttagttctttgagaaatctctatactgttttgtatagagtttgtactaatttaaattcccaccatcagtgtgtaagtgtattctttcctccaccatttcctccattttctcaccaacaggatatttttagtctttttaataatagccatttttttccaagatagaagattagaggcttttaacatgcctcagccacttgtaaataccaagataatgcattaagataaactctgttagctttaacacaagaagaaaaatgggaatccactgaaatcatgaaggacacttcagatcctggggaagaaaatgagggtaaacagccccatgtgagtgtccagctgataaaagtgagtgaaaccataatacatgagagaggcagagagcttcattctgtgactcagctttccacaggggttatgagcaaccaggctgaagcagagcaatttgtttctcccgtgcactgtaactaacatgtggagaggcttggaggtgtgggaagaaaagacactgggaaaagtagccggcattttcccagatctgggactgacagcaggaagccttttattccaggtgcatatgaagccatttttaatccagtggcatataaagctattctttggagacctagcagtatggccatccatgcaagcatttcagtcttgggccagagattggagtgcttgctctagaatgggttagaaacttctacagccagaactgtggcaagcaccccagcagtaggcactgaaattgtgctctctcctgccacaggcctggggtgagaggaaagctgtcacagtgacagtttcctctgggcaacaagacttgcatccagggccagcttggtgacctggaaatggtgtttgtgtgcccttgctgcatgccccagtctgcttccctgagattatgttgtagtgggattctctctgctccacctaagagcactcactcccatggaccagcaatctgaggcaccccacccttcatgaagcagagatcatagtacagcagggccctctcctctctacacccaggcaaaactccaggcattcagaacatctgttcatcttccttctgcatagattgtgatgcagtgagaccctctctgttccacaaccaggcaggtctacaaatttggagcacccatttgtatggattagcaaactgaggtgccccactattactatgcagagatcctggggcaagctgaccttctccacttcatgcccaggcagatctagagacattcagagcaactgtttgcctggttaagcagcttcagacacgccacacatcctgggaatggatggtggtacagtgaggcccttttcactccacacacaggcagctctccaggcatttggagtacctgctcgcctggatcagcagcctgaatgatcctacccttcctgcacagtgattgtggtgcaggtggacatctctgcttcatgcccaggcaaaactccaggtattcaaaggacctgcttgcccagcttgagctgccatgcccttcctgtgcagaaatcctgtacctctctaattcaaacccaggctgacttccaggcattcagagcacctactttcttggctcagcatcctgagctaccccacccttcttatgtaaagatcgtagtgtagcggggccctctccggtccatgcccaggaaaatctctcggcattttgagcacaaatttacctggattaccagcctgagttgcagtacccttcttgtgcagggattgtgctgtagggcgtagctctatactccatgcccaggctaatcgctagacatctagagtacctattctcttgaattagaaatttatgccactcccaccctcagtgcagaaaacttgaggccaaagaggtttccaaggtccgtgcctaggcaaacctctgggcacctggtggtcaaacactggatgcttctgcctgctaataggggacctgtaggaggatctgtccagcctggcccccgtcatctttcccatcccaacccccggaggctgatcagggaggtgaaactatgtgtactccacagatgagctcattgcttgaggcaacagagaacttctcaaagtaaacgagaatgaagtatattcgcagccacagcagccaaaaccggctcttacctatccacgccatctactggcttgtgggtcaaactgcaagcccaatataaaacctattgacagaagtgcatagggctgcagaggcaaagtgaaaagacccctacccagcactctctacagtcacacccctctaggaggcaggtacagggaaagggaaacaactaatattatagagaaagtaagaaaaaaatcttacctgcatgaaaataattacaaaatttataagtgctagtatctttggattagaaggaaccagtgaaagaatactgacaccacgaaaaacgtcaaagtgatgacaccagaggatcatactggctctccagcaatgatccctaaccataatagaaactcagaaatgaatataaagaattcagtgcatggattgcaaggaaattcaacaatatccaagacaaggttgaaaatcaacgcaaagaaacttctaaagcaatgcaggtaaggaagaaaagataaacatcttgaaaagaaatcagtcagaacttatagaaggagaaacctcactaaaagaatttcaaaatacaattgaaagctttatctaaggactggaccgagcaaaataaataactttagagcttgaagaccagtcttccaaaataacccagtcagacaaaaataaaggaaaaaaggaattttaaaaagtgaacaaagtctttgagaaatatgggaatgtgtaaagtgacaacatatgaattactggcattcctgagagagagaacaaatagtaaatagccaggaaaacctatttgagggaataataccagaaaatttctctttttttagagaagtagacatcctgacacaagaaataaatatggcatctgtgacatactatacaaaatgaacatcaccaaggcatatagtcacaagactgtccaaggtcaatgttaaagactaatctttaaaaagaaaagattaaatcacatacaaagggaactacatcaggctaatagcagactttttatcagaatccttgctaaccaagagagattggaggcttattttaagcatttttaaagaaaggaaattccactcaagaatttcatattccactaatataagcttcgtaagcaaaggtgaaataaaacctttttccaaacaagcaataactaagagaatttattataacaccagccttacaaaagatctttaagggaattctaaacattaaagtgaaagaatgatacctgctaacacaaaaacatacttgattacctatcccacagaccttataaaataaccacacaatggaagctacaaaggaaacatctaacaactccatggtaggaagaaaacctcacatataaatactaaccttgaaactaaacagtgtaaacaccccacttaagaggcatagttccaagttgagtaaaaaacaagacctctccatctgctgttttcaagagacttatctcacacataatgccactcattggatcaaagtaaaggtttggagaaacagctatctcacaaatggacatttaaaaagaccatgggtcactatgcttatactgaacacaatagactttacaccaaaaactgcaaaaaaagacaaagaacagcattacatattgatgaaagttcaattcaacatgaagaccccatacttaaatgagatagttaacctatttagagcatccaccattagagcaacaccattgataaaacaagtactttgagacttagggaaagactaagatatccacgtaataatagtgggaaacttcaaaccccactgagagcattaggtagatcatctaggtagaaaactaaaaactgagttttggaaagaaaatttacacttgaccaattggacctacctaataaacagcaaataataataaacctaataaacagaacccttcacccatcaaccacagaatatataatcttctcatctacacatggaacatactacaaggttggactcatgctcagccacaaatcaagtgtcaataagctgaaaaagaaaaagaaaatcatatcacttgtactgtcagatcacagtggaataaaaacagaaattaataccaagaagatctccccaagccccacaattacataggaattgaacaacttgctcttgaatgacttttggcaaagcaacaaaattaaggtagaaatacaaaaatctttgaaatcgatgaaaacagagacacaatatactgaaatttctgggatgcagcaaaagcaatttaatggggaacgtatatattgcactaaacacctatctcagaagttagaaagatctcaaattaataatatcatacctagaggaactatataaacaagaacaaactaacaccaaacattggttctttgaaaggatgaacaatattgaatgaccactagctagattaacaaaaacaaaacaaaaagaagtttcaaatatgcacaatcagaaacaatggtaacgttacaactcatcccacagatacagattatcagagacttttattaataactctatgcacacaaactagaaagtctagaggaaatggataaatctctgtaagcacataacctctgaagattgaatcagggaaaaattgaatttctgaatagagctatatcaaattgcaaaattgaatcattaatgaaaaacataccaatccataaaagccttgaagcaggtagatttgcagtcaaattctaccagatacacaaagagctgttagtatttctattcaagctattctaaaaaattgaggaggaaatactcctccctaagtcattcaaggaaaccagcattaccctgacactaaagcctgcaaacacataacaaaaagaacaaactacagaacaatgtccttgatgccataacaatcttcaacaaaataatgtcaaaccaaatctaatagcacatgaaaaagttaatttaccacgatcagttagcctttattcctgggatgatgcaagggtggttcaacatatgcaaatcaataaatgtgattaaccatgtgaacagaattaaaacaaaaatcatatgatcatcttaatagatgcataaaagtgtttgatggaatatcccttcatgataaaaattctcaacaaactaggtatcaaatgaacatacatcaaaataattagatatgtcggtgacaaacccacagacaacatcatactgaatgggcaaatgctagaagcattccccttaacaataggaacaagacaaggatgcccactctcaccactcctattcaatatagtgctagaagacttaaccagagcaatcaggtaagagaaagaaataaaagacatccaaataggaaaataataagttaaatatctctcttcactacatttgaaaaaaacaaaaaactattctaaaatttatatggaagaaataacagagcccaactagccaaagcaatcctaaacaaaaagaacaaagttgcctgggcatgatggctcatgactgtaatcccagcactttgggaggctgaagcaggtggatcatgaggtcaggagttcgagaccagcctggccaacatggtgaaaccccgtgtctactaaaaatacaaaaattagctgggcgtggtggcacacacctgtaatcctaactactcaggaggctgaggcaggagaattgcttgaacctgggaggcagaggttgcagtgagctgagatcacgccactgcacaccagcctgggcaagagagcaaaactctgtctcaggaaaaaaaaaaaaaaagaacaaagttggagagatcatattacctgacttcagactatactagaaggctacagtaaccaaaacgtcatggtgtttgtacaaaaacagaaacataaacaaatgcaacagaataaagaacccagaaataaagctgcacacctacagccatctgatcttcgacaaagttgacaaaaataaacagtggagaatggaattcctattttaatggtgctgcgatagctggctagccatatgcagagaactgaaaccagacttttttagtaacagccattctgactagagtgagatatctcattgtggttttaatatgcatttatctgattattagtaatgtggaccatttttttcatataccttttgcccattattgtttcttcttttgaaaacatatctattcatgtgtgttgcccactttctaatggaatcatttgtttcatcttgttgatgttcttgaattgagtttcttgtatatgtggatactagtccaaaggttacttctttatttatgcaactataatgcacagtgaagcattagtattcttaggtttttatttgtacagtccttgaggggtttgagagtacaactttaaaagtgcacaaaattcatcatgatactggtcataataaacacacatcaagtgtgttagcacactatcattagactgtagcaatcctaaacatctgtaacaattttgtaacataaagcataactagaaaacttatttcaaagatctcttagtatatatgactgaagtttctcagccatggatgatactagttttgaatcaaacacttaaattagtttattatgcctcctcttatgtccaggtaaaattagaatgtccaagaatacacatttctttggactgaggagtttttcagaacacagatttttggtgctaagccatgaaagttccattaaaaaggggaaaagttgttaacatgagttacatggtttctagtttctataaatccagaaatgactgtcccctcctcacccactgttaaatacatgtagacttgggcaggaatacaggactttttttgatgtttgatgtacttttgatttcaaagcaattaaatctgaataaagagaacatcaaagggcagattaagtctcttaaaatatttctgaatattgtggggattttctgagcagcctgcttcagaaattctaaaatgtgatgaatgagcaatctagtctcatgctctggaagcctttgaagacttgaggaccaaatagtgggaatagaaatgagcaactttgatcaatgtcaagggacacttctcccctaaaacacacatacaaaggaccacttaattgtacattctagtagctttccttcgacatgatattttgttagcaacttttccttctcacagaaactattacttatactcttgattttttttattatcagcatcagttggcctagcattcaaagaaaggagtagatgctgactaaatatttactagtggatacaaaatagatcacatattgatggtcataaagaagatatgaaacagaaatttcccttctatatatattatattcattaatgtatttgagtcacactggaacaagaaggcacacattatatcaaacatggaggagagatttaattttgtattttattttctattctaagcttactaggacatactactattcactatcttgactaaataattatacttcctgaatcatattacatcagaactttggtgaacaacaatgacataggaattaatagtagacatgaaggtgagtgaattaaataaaaggttattactatattcttataaagtaattaattaaatttttagcattttgttttgttaagattttacatatgatttttttaacatgctactttataatttcattttttaaagcattaagttttaaacatctttgtacatcattaaatattcttttacataaatatttttaggtaactacatagatattcattttataaaattatcatgatttttaaaacatttttcattgctggacctatgggtcatttttatttttattactataataaagaataccgcaaataaaacatttagattttcatgctaattgttgtcttatatagctttctatatataaagccgaggaaccaaataatgcacaaatgtttctggttttgttaaatgggcattcaaacatactatacaaacttactctcccaagtatattgtgcaacagtaccataatataaatgatcattaattatccataatttgtgtaagcttcattttttcttcttacgttagaatggaaaataaagcatattgtatattgatttagctagtgtatcaaggctgttttactagaacaatacatcatgatcatactttctttttgactactttagggattatatttagtttcattcttataaaaatttatagcttaatgaataaatgaacaatgaggtaatgttcttcaaagcatgtccagttttatatcatgattcatcacatataagaactgctatagaaaagataatgctattctagaattgcatatatgacaggttgatttatctttgcattctgtgtgttttgatgtacagactttttaatggcattcattcattaatttcacagggcatgcctcctatatgtatgacaccatagtggttctagaggtatataaaatgaataaaatacagactctgcccttaaggagtttaaaaactagtaggggagagacatgaaaataaatagccatgatacagaatgaaatgttaagtgcccccagagaggtgaaagcatactccaggaaaatgctgatagatgcaattgcttctacagaaggtaaccaggtaaattgacattggttgggactttaaatattgaatagtgttttattctttttcagaacagtcattgttttggcacttttaaaaataatgaaaggcaaatcatatttccatatatgataagtaacactaaaatactcacatttcttaaaatgtcaataatggaagggatctcaaagatcatctagtcctatatgttattaatatcaagacatgaataaaatattttggaaattgaagtatgcttacaacaaaacctcaactatccataatcatgtaataattctgtaagagttctaaccttgacaaatacatttgtctgcttcctagtctatttgttctgggcagcaacttgactttttacagttcatttggagagaaatctttagcaaactacttgggatccttgatttggttaaagctagaggaaattgtggctgaaaaaagaaaaaaaaaaaagacttaataggccaggcgcggtggctcatgcctgtaatcccagcattttgggaggcagaggcaggcagattgcctgaggtcaggagttcgagaccagtctggccagtatggtgaaaccctgtctctactaaaaattaaaaaaaaaaaattagctgagtgtggtggcatgcacctgtaatcccagctactcaggagactgaggcaggggaattgcttgaaccagggaggtggaggttgcagtgagccaagattgcaccactgcactccagcctaggcgccagaatgagactctgtctcaacaaaaaaaaaaaaaaaaaaaaaagaagacttaatatactttcagatgattgtattatctttattgataattaatatttaagttacaataaatttattgattttctttttattggagagtattttcaattgaaaatcagaatattgggatttagtttttattgtttaaataattactagtttgaacttaggaaagtctttagacttttcttgacatatattttctcacccaattatttccaatcccttttaactatatctaaaatatttgctttttttctttgtaaaatcgtgaacaaaatacatatatgatattgatactactagatagaaaggctgtgaagttggctgttggaaactctcatgctcagttctcattacatcaaccatttcaattgtttcagtacatgattttataagacctttctcccactttcccagtgattacggcatcctacaagttattatttttgtcttccatttctatttaatacactggtaaaattctaagccaaaatttaactgttagttcaaactactttttaagggtataattttatgctttatttgccctttaaataaagctacataattgctctagagagaataagaatgcatgtgggatataatataacatgtaccttttctgaacaaggaaaaaaagttgtgcaaattgaagctgtaattactacgtgcaggcgtaaagaaaaaatgattttctagtcactgtattcattcaccttgagtaggaaattatagtttttctaatttaaaaaggtcactttatttttctgagcatttgattggttgaatatcacacacttttactttttgcatgaattgggctgtttgggggttactgtctagaaaatgttgagacatttatttaaatgcagagtatattattgattccagactgtcaactcaaggctaaaatcctgcttgaaacatgagaagtggataaccatgtgcacatgactagtacctaccccatgacagtttcttaagaaccctgtagtagaattaaattatcagaggttatggaaacggctgcttgtgtctagtgagtatcacactggaaggtcattattgaggcagccataatttttattcacaatacacacacaaccaatagtgccaagataattcaagactgaacatcccatccacacaccaacctgtagattcctgccagttcatgcaagtcagggaattaccaaaaataaattttaaaaattagagtatattccagtggatttaattttgaatgaattttttgtcaaaatttt

SEQ ID NO: 883 - DNA, 36085 bp, Homo sapiens
ttctgctatgttttctaggaaattattgctgatatatgataatactattaatactatcgatttttgttatttgagtttgtatctggagagtgtgttgaatgctttatttgttgtagactgataccatcccagattacattgacaaatgttgtaaaaattgtttcactgtcttatgccagaagctacctgtggtccatctactacaggtgattgaatcttcattgccatcaggatggaaaatgatccagacacaaaatccaatattagcttctgctgtttttaatgactccatttttggtaatacttgccaaaatgatggtgtccagtaagtagatgataataaatatgcaatattttattggagaattgacagctatagaatggggatgaaggaagcaggtttggacaggaggaaaagtgttactaggcagcccaaatgaagggcttagattacctgatgaggaactctggatcttccagagccttttaaagttattctgagttggagaaaagaggctgttattgtatactgctaccttaattagtcactggatgtaggcttctcatggaatagacatggctttgggcaaatcaattgtttttcaaatgaggcactttgcaaaggaattgaacattgaaagttatcttctggaagcaatctcactagctagggcagtaagatttttataaagggggatctgtgaagcccattacagtgtattcattacatatacattcaattttgtgtctgtaattacatacacacataacacaatatagcaacatttttctgataatttttatttgtgaggtaattcatttttctagtgtttttgttgttttctttgtagcatatttttatagatcttgtgctagttctttctttccttaaaattttttattgaatgaatttgttttttctcgtcccggtgttttctaagtttctcttattattatgaactggtaagttaaacatatctagatagctcattttcagaatgccaaaggcctttctttctcagtaaccacaaacacacactgcttcctgcaaatatggcttgttgtgtgaatcttagtctatgtaaatcttactgcctttatttatctgaaattaactgggctggaagagctcctgccaatatcctgcacgctttatattttctacatcttgcaactcttttgcctttaggccatattctctcctcagaagttatattttgtcatctactttagctaagttcagcatcaggaaactatcctcagtttttctcctattcagtacatgtgtattttgaataaatatgcttgcttttgacagtcattaatgtattatggtttcataaaaaaaaatcttgggttttttatctttcacattcttatacttttgagtgatttctaggaggagaaagaaaaaatgttcagttttctaacccatataaattctggaaattaactaaatcctatattaaataaacttcttaaaagtctttctacgaatataattaggcttgcagtggattctatattatgttgggaaaaattggcagccttacaatagtaagtagtccattctattaacttggcatttatcctagcgtttctttatattcttaaacagactcataatacctcaaagtgtgtattgttattatggatagtattctgctttctactatgttttctaggaaattattggtaatatatattactattaatactattgatttttggtagttgagtttgtatctggagagtgtgttaaatgctttatttgttgtagactaatactcttgcttttcctaagacattttatttcccttagaattatgcttctacttctctcatttttcttcctctgagattatattgaacaattgtatatcatcttgttatcatgttctgttcatgttgaatagtaaacattccagtgttgttactgatttgaaaagggattacatgtatagttatctctgatgtttgtatattatgttggtagctatattagataaagagaactcctactcaaaattactaattctgagcattattaaatattttatacattgaaattgatcaaatatatttgggacattaatttacaattcatatcttaactaattaatggtagaatacattgacaaaagttcctgttattaagataacatttgaatatctgggcaaaacctttcataattatgatccactgtaaaaatataaagatagactcagataatacagtcatttagaattgtggtgtggatgagcacaagagaaatgacttttctgttttcatgtcatcttaactaattttgaaattaattattgtgatgattattattgcatgtcaacttgattggattgaaagatgcaaagtattgttcctgggtgtgtctgtgaggatgttgccaaaggagattaacatttgagtcactggactgggaaaggcagacccaccctcaacctgggtgggaacaatctaatcagctgccaggacagctagaataaatgcagaaagaagaatgtggaaggactggactgggaaagtcttctggccttcatctttcttccatcctgaatgcttcctgccctcgaccatcggacttcaagttcttcagcttttgggctcttggacttacactattggttttccgggggctctcggtccatcagccacaggctgaagcctgcatcatcagcttccctatacttttgaggttttgggactcagactggcttcctggttcctcagcttgcagacagcctactgtgggacttcaccatgtgaccctgtaagtcaattctcctaataaactctccttcatgtatttatctgtcctattagttctgtccctttagaggaccttgactaatacagattttggtaccaggagtggttctagaggaacagaatttcaaggatggatttctttagttgattttggggtttctggagttggctgcttaatatgattagatccaaaaatgctaaggactctacttctaatagtatgcagaacactgagagtccttggtatgaactgtttagagttaagcaaaataaatgcatttgatactcctgatccactactcatgagaggcaaggagtttagagactctatgcataatatctatgatgataggtggagaacaaaggaatataatgaagttggttggttactcttcagttggttggacaaagtgatgaggaaaacagtgaactcagggatactaattcccggcttcagaagcgcatactgagcctcaaatcttctaagattgccctgagtgagagtcttgtttcctgtaaagaaagagctaaaattgtggaaaatcagacaccagctcttataatgcaagtggctgacctgcaacaaaaggggcatgcacagcctcaccaggtgtctattgttaaagtgagggcattgattggaaaaaaaaatgggactctgcaacttgaactgggggatgtgtgggaggacactgatgaagctgaggacactgagcttgtaaactctgatgactctgatgagtcttttttttttttttttttgccagaggaaacagcttccctaccacagtggtggcaaaattcccaccctgaccctccctgccattagcctttccacttttgtttgagaataaccctgcactgcccgaggcgagaataacggcctcccctgagacagttgccaggaaagacaatgttgactttcctcaggaccaacccactacacccctgtttgcttctagacatttaacaagactcaagtcctggcaggcccctagaggttagggtcagagtgtgaaccatgaagaggtgcactacactccaaaagaactgcttgagttttctgatgtatataagcagaaatttggagaacacgcatgggaatggatattaagggtgtgggataatggtggaaggaacataaagttggatcaggctgaatttattgatttgggcctactaagtagggattctgcatttaacgtagcagttagagcttgagaagtttaaaaagttgtaatagtttattggcttggttagttgaaatacggatcaaaagatgtcccactgtgagccagctagaaatgcgtaatctcccttggtttaatgtagatgaagggatccaaaggcttaaggagattgggatgctagagtggattagtcactttagacctactcatcccagctgggagggtctagaagacatacccttcaccaatattttgtgaagtggatttgtgagggcagcacctgcatccttgaagagtgctgtgattgtgcttctctgtatgtcatgtcttacatggtgagctacagtcactcaactacaaaattcaaatgcactgggactaattggatcccaaggtggcagaggctaagtggtggcactcaaccaccaaaggcaaggtgggtgtagttactgtaatggacagcagaggcaaagcaacaatcagaatagtctgagtcatgaagaactctgacattggctaattaatcatggtgttcctagaagtgaaattgacaggaagcctgctacactgttactcaatttatataagcagaaaacttccagatcgagtggataaaaggctaatttcgattataaaaacagaatcatggcccctcaatcaattttcagacttgacctgtttatagatccagaacccctttaatgaagggaaggttgggtccccttgaggcagaacctcactacactactgacaatttatgatgtttatctttctcttatccttccccaaagagaccttcagccttttaccagggtaacagtgcattggggaaaggaaaatgatcagacctttagggtaccactagaccctggctctgagctgatgttgttgattccaggggatgcaaaatatctttgtggtcctccagttaaaagaggggattatggaggtcagataatagaattttagctcaggtcggacttacagtggggccagtggttccccctacttatcctgtggtcatttctccagtgccagaatgcatatttgacataaacatacttagcagctggcagaactcccacattgactccctgactggtagctattatgggttggggctactatggtggggaaggccaaatggaaaccattagagctgcctctacctagaaaaatagtaaatcaaaaacaatatcacatccctggagggattgcagagattagtgccaccatcaagaacttgaaagatgcaggggtgatgattcctatcacatctccattcaactctttcatttgtcctgtgagcaagacaggtggatcttggagaatgacagtggattatcgtaagcttaaccaactggtgactccaattgcagctgtggtaccagacgtagtttcattgcttgagcaagttaacacatctcttggtatctagtatgcaggcattaatttggcaaatgccttttgctccattccagtccataagcccctccagaagcaatttgccttcagctggcaaggccagaaatatacctttactgtcctatctcaggcgtatatcaactctctgggtttgtgtcataatcttgtttggagagatcttgatctcttttcccttccagaagataacatgttggtccattacattgatgacataagctgattgaatccaatgagtgagaagtagcaaacacactggacttattggtgagacatttgcatatcagacaagaaaaataaatcctactaaaattcaaagactttctactttagtaaaatttctagtggtccgttggtgtggggcctgtcaagatactccttctgaggggaaggataagttgctgcatttaacccctcccacaaccaagaaagaagcacaaagtctagtgagcctaattggatttaggaggcaacacattccttatttggatatgttacttttacgcatttattgagtgacctgaaagtttgacagttttgagtggagaccaggaaaaggctatgcaactggtccaggttgctgtgccagctgctgtgccacttgagtcatatgacccagaagatccaatggtgctttgggtgtcagtggcagatagggatgctgtttggagcctttggcagacccccataggcgaatcacataggagacctctaggattttggagcaaggccctgtcatcttctgcagataactactgtccttttgagagacagctcttggcctgttacagggctttggtagaaactaaacatttcaccatgggtcatcaagtcaccatgtgacctgaactgcctatcatgaagtggatgctttctgacccatctagccaaaaattggagcatgcacaggagcattccatcatcaaatggcagtggtatagtggtataaacatggtcaggctagagcaggttctgaggggacaagtaagttacatgagaaagtaggtcaaatgcacatggtctccactcctgccaccctgccttctctcccccagcctacaccgatggcctcatggggagttccctataatcagttgacagagaaagggaaagcaagggcctagtattctggtagctctgcacgatattcaggcaccacttgaacgtggacagctgcagcactacagcccctttctaggacatcactgaaggacagtggtgaagggaaatcttctcagtgggcagaacttcaagcagggtacctcattttgcactctgcttggagggagaaatggctggatgtgtgattatatactgattcatgggctgcagctaatggtttgtctggatagtcagggacttggaagaagcatgattggaaaattggtgacaaagaaatttggggaagaaatatgtggatggacctaactgagtggtcaaaaactgtgaagagggtcgggtgctgtggctcacacctgtaaattagccgggcgtggtggcgggtgcctgtaatcccagctactcggaaggctgaggcaagagaatggcgtgaacccaggaggcggagctcgcggtgagccaagatcgcaccactgcactccagcctgggcgacagagcgagactccatctcaaaaaaaaacaaaacaaacaaaaaaaaaaacctgtgaagatatttagatatttggatgtcatgtgagagctcaccaaagagtgacctgcacagaggagaattttcataattgagtggatagaatgacttattctgtggacaccactcaacctctttccccagcaaccctgtcatcacccaatggtcccatgaataaagtggccatggtgacagggatggatgttatgcataggctcagcaacttggacttccactcaccaaggctgccctggctacagccaccgcggagtgcctaatttgccacagcagagagcaacactgagcccttgatatggcaccattccttggggtgatcagccagctacttggtggcaagttgattgtattggaccacttttattatggaaagggctgtggtttaccctcactggaatagacacttactccaggcatgggtttgcctatcctgcacacaaagcttcggccaagactaccatccatggactcatggaatgccttatccaccatccaccatcatggtattccacacagcattgcctctgaccaaggcacctactttacggctaaagaagcgcagcagtggactcacgctcattgaactcactcatcttactatgttccctgtcatcctgaagcagctagattgataaaacagtggaatggccttttgaagtcacaagtacaatgccagctagatgacaacactttgcggggctgggacaaatttctccagaaggttgtgtatgttctgaatcagcatccaatatatgatactgtttctcccatagccaggattcacaggtccaggaatcaaggggtggaagtagaagtggcatcactcaccatcacccctagtgatccactagcaaaagttttgcttcctgttcccgcaacattatgttctgctggcctagaggtttttagttccagatggaggaatgctgtcaccaggaaacacagcaatggttccattaaactggaagttaagattgccacctggacactttgggctcctcctacctctaagtcaacagactaagaagggagtcacagtgttggctgggttgactgactcagactatcaagatgaaatcagtctactactccacaatggaggtaaggtagagtatgtgtggaatacaggagtatcccttagggtatctcttaatattaccattccctgtgattaaggtcaatggaaaaatacaacaacccaatccaggcaggactacaaagagcccagacccttcaggaataaaggtttaggtcactcaaccaggtaaaaaaccataatctgcggaggtgcttgctgaaggcaaagggaatacaaaatgggtaatagaagaaggtagttatcaataccagctatgaccacatgaccagttgtagaaatgggagctgtaattgtcattagtatttcctccttattttgttaagaacatggttgtgcatatacacacttgcaggaagagaatatcttcattttatttcctttctttttcccttatacgacataagatttactgacttcatatcaacatttaagtgttgttaagtttatgtaatagcatttgggtcggggattggtgagtttccgctagtatgaaaaagagctgcattatattaggtgtaattataacttcatcattgtctttatttgaagagtatgtatgatttcaggagatgtgtatgggttcaagttgacaagggtagacttgtgatggttaatattgagtatcaacttgattgaattggagaatgcaaagtatttgttctgggtgtgtctgtgagggtgtagccaaagtggattaacatttgagtcagtagactgggagaggcagacctaccctcaaccttgatgggcataatctaatcagctgccagtgcgactagaataaaaggagtcaaaagaacgtggaaagactggactgtctgagtcttgtggcctcaatcattttcctttgctggatacttcctgttctcaaacatcagactccgagtttttcagcttttggactcctggacttacaccagtgatttgctaggggctctcaggccttcggccccagactaaatgttgcactgtcggcttcccaactattgaagttctgggactcggactggcttccttgttctttaacttgcagatggcctatagtgggacttcactttgtgattattggagtcaattctcctaataaactcccctacatatatttatctttccaatgcgttctgtacctttaaagaactctaatacaagtatattctaactttgacaaataagtgaggcattttttctcatgttttatttttcctgtgaaagttgtataaaatagagttttccttgataatttggtagaatatttctgtaatacaatcttgtatgggtataaagcatgtgtggatgggtgttgggtgtggcagtggtgggcaatgagaagtctctaagtagcatttcagttactgtcatgcttctttatatgtctactatgctaactttggcattttaaatttttccagaagagcgtattcattttgtctaggtttgcaaattacactgacatataattgtgtgcatgtccacataaatgtgtgtatatgtgcacacacacatatatatacacatatatttatatgcacaatgcatatgtctctacatatatattctgatttgactaaacttgttttatttagtttttttgtttgctatcttctttctcttatattgaagaagtttttctagagttgtgtttgcatttcaatcttctccaaaaaatatcctttggatttgcttaaacttattaatcatgccagtcaaattcactatactgaaaaaggtttctaagagttctcatgctattcttcatgctttaccttcagactgtctttacctactttttgtctggcgtactgggtgtatgagagggagctggagttccaacatctttccaagagttaccaccttttcaggagctgatctcagaaaaaaaaagtacagacagggacaggtagaatagctataaaactcgaagatgtttgctatgtcttttggcccattgtgactgctataacaaaatgctataaaatttgggtagattataaataaaaaagaaatcatttctcactcttttggaggctggggagtttaagaaaaaggtgccagagaatttgatgtctggtaaggcctactttctggttcatagatggcaccttctgaattctgtcctcacatggtggcaaggtcccttgggccactttaaaaaggtactaatcccattcatgagggaaccttaccaattatgtaattgcctctcaagggtgttatttcctaataacatcatattgtggttgaggattccagcatatagattttcaggccattgtactatgttaagcgtgcttttactaacaggtaagcactaaactaataatgccttaataattgagatttagtcttctcagttcataaaacgtctggaggacagaatttgctagcaaaggtttaatggttaagtgttatcataactctaggtcaccatcttatactacctcaatttgtattgtagtaccctttacactcaacctgcaattagcacttactctgtgccaatcttttcttttaaaatagacaattttttttcgcatttaatccttacagaaaaactataaggtagatcttgttatttctccctcagatgagtcaatgggaaataaaaatctttaccaaaaatttccaacaaacttcacgttatttcttattggccaacactgagtcacagcttcttcctttgctagggactggatttttatttcatgaaatcaaaagatctgtgtctataccagaaaaaaaaaaattagggttttgttaccaggcaaaaatgcaagtagaaataatagtctccaaactaaaatctttgtggaagaattgaaattatgggagaaataaatcaaaagttcatagtgggtacaatgagagataacttatgcaaattatatgagccacataattgatattattgatatcattgctattacttagatttaaatacataagtaaataaaatgctttcaatgttttttattttttaaatagaatgaaaagtttttataatagatgaaaacaataaagatgaaaccactataacattaagaattataaaatcttattgtattgaacttattgtctttgaatgtattcaagtgaatttataaataaatacaataagtgaattgcagcacaaaatataatgaaatccaaagatcaagtgcatgttttgaccatcagtattgtgttttggcaggagatatgtagaattgatcattaaaggctttttagaactgttggagaaaaaagtctaaaaaacattttaaactatatactataaagtatgacagttaatgaagttaaagtgtatgtaaaactgtagaaatatactataaaataggacagttaatgaaggtaaagtgtagtaaaactatagaaaacaagaaatagaatttggaaaaataccatgttttgagatatctttgtaaatccatgcaactatatttgtaataaaatttttaacaaaaatatgagcttatggttatgtaagctgtatgggatgaggtttaagattagatcacggtgatgataaaacacaaattgtgcaaagaaacatttaattcattagttatgtgaagcataatatacagtcatggaagttcatacctcttgcagtcaaattttccagcaatccagtgctagcttaagtataaaactattatttctgaagttgctttctaatatattccactcgtaaataacttctattttttatcatcctttttagcatttcatttgtatctcttaatgaaagaaaatgaaaacttttagagccacataattgatatcatttgtatcaattacggtaacatctggtagttagcagtatattcatggacctaagctttctctcttactaaagagtctaacttccctaatggtatatatgtaatttttggtttttctctgtattcagtaccattcccctgatgctgaccgacatgtatagagaacagaatacagtgtatttttattgataaaattcagaatattgatttaatggtagcagagttgtttattaaaaaaaaaataagcacaacagttcccaacaacaagctaccaaccccttgttaattgaaggaaaatacctaagacttacttataaaacctacatacagaattttttgaaaaaaaaattttagttaaaatatgaactcaatgacttctatattattcccatcttttaatactatgttattgcttaattcttactaaattgtgcattcattattaatagaaactataagaattcaaactaataagaagatttttaattgctacaaagacattttaaaataagattaaatccaaagaaatctatattacacatcatagatttgttaaaattgctgatgtttttctgacatttgtatgggtttatgtgcttaagaatcaggtgcgaatcttgataaaaatatacatattcagaatgtaccatttgatattttaaatctttggggataagggtgagagaagattcaacatttttatcaatttctcaagctgattttgatacaccatgaagttttataagaactgatacaattttttttctttactatggctgaagggtgtaagtgaattaaggtgagaagtaattttcaatgcactagtctagaactgtacagatgacaaatgatatttcaacagatgaagaaaaaataaactttactatttatagaaaagaatttgatttcactctttgattcaagagtgaaaaacacaataattgaatgcactttgtggtgatggtggagtcttgaggttctgtttttataagtcacaatatttcaaattaaccatacagaaaaaatattgtatttccttatattggccagccagaaagttactggacaatgtcatatacaatatgagtgccaggccagggtccgttaataataaaggagctggtgagtgagacaatttagatggctcaatggggtgtttcagagacagactttgttgaagttatatttagttggcagttataagttagataattaaaattatctaatactgagtcaggtgcggtggctcacacctgtaatcccagcactttggggggctgaggcaggtggatcacttgaggtcaggagttcgagaccagcctggccacatggtgaaaccctgtctctactaaaaatacaaaatttagctgggcatggtggcatgtgcctgtaatcccagctacttgcaaggctgaggctgaggcaggagaattgcttgaacccaggaagcagaggttacaatgagccaagatcacggaactgcactccagactgggtgacagagtatccatctcaaaaaaaaaaaaaaaagaattatctaatactggattcttatgtgataattaccaggttttagaaattttgaaaagtatacaaacacatagaaattcctaagaatagtgactcttcatttgaagaactaatgtttttcctttagagtctatgaatgggctaagtgttgctgttcaaacgattaggattatttcactagtatttagaagccttcaagtcagaaaccaaagaagagctgctactgaaaagatatcattaagtaatcatccacatctctcccaacctatcacccttctaagtatccattgtctaacatccctctctctatgtccatgtgtacgcatttcttagctcacatttatgaatgagaacatgcagtgtttggctttctgtgcctggtttgtttcagttaataactgctagttccatccatgttgctacaaaagacatgatttcattcttttttaaggctgaatactactttgttgtgtatatataccacattttctttacccaattatccatggatagacactgaattttccatatatttgctatcacgaataatgttgtggtaaacatagagcacaggtgtgatatatttttgatatattgatttcctttggatagatactctgtagtggattgaatagtagtactatatttagttctttgagaaatctctatactgttttgtatagagtttgtactaatttaaattcccaccatcagtgtgtaagtgtattctttcctccaccatttcctccattttctcaccaacaggatatttttagtctttttaataatagccatttttttccaagatagaagattagaggcttttaacatgcctcagccacttgtaaataccaagataatgcattaagataaactctgttagctttaacacaagaagaaaaatgggaatccactgaaatcatgaaggacacttcagatcctggggaagaaaatgagggtaaacagccccatgtgagtgtccagctgataaaagtgagtgaaaccataatacatgagagaggcagagagcttcattctgtgactcagctttccacaggggttatgagcaaccaggctgaagcagagcaatttgtttctcccgtgcactgtaactaacatgtggagaggcttggaggtgtgggaagaaaagacactgggaaaagtagccggcattttcccagatctgggactgacagcaggaagccttttattccaggtgcatatgaagccatttttaatccagtggcatataaagctattctttggagacctagcagtatggccatccatgcaagcatttcagtcttgggccagagattggagtgcttgctctagaatgggttagaaacttctacagccagaactgtggcaagcaccccagcagtaggcactgaaattgtgctctctcctgccacaggcctggggtgagaggaaagctgtcacagtgacagtttcctctgggcaacaagacttgcatccagggccagcttggtgacctggaaatggtgtttgtgtgcccttgctgcatgccccagtctgcttccctgagattatgttgtagtgggattctctctgctccacctaagagcactcactcccatggaccagcaatctgaggcaccccacccttcatgaagcagagatcatagtacagcagggccctctcctctctacacccaggcaaaactccaggcattcagaacatctgttcatcttccttctgcatagattgtgatgcagtgagaccctctctgttccacaaccaggcaggtctacaaatttggagcacccatttgtatggattagcaaactgaggtgccccactattactatgcagagatcctggggcaagctgaccttctccacttcatgcccaggcagatctagagacattcagagcaactgtttgcctggttaagcagcttcagacacgccacacatcctgggaatggatggtggtacagtgaggcccttttcactccacacacaggcagctctccaggcatttggagtacctgctcgcctggatcagcagcctgaatgatcctacccttcctgcacagtgattgtggtgcaggtggacatctctgcttcatgcccaggcaaaactccaggtattcaaaggacctgcttgcccagcttgagctgccatgcccttcctgtgcagaaatcctgtacctctctaattcaaacccaggctgacttccaggcattcagagcacctactttcttggctcagcatcctgagctaccccacccttcttatgtaaagatcgtagtgtagcggggccctctccggtccatgcccaggaaaatctctcggcattttgagcacaaatttacctggattaccagcctgagttgcagtacccttcttgtgcagggattgtgctgtagggcgtagctctatactccatgcccaggctaatcgctagacatctagagtacctattctcttgaattagaaatttatgccactcccaccctcagtgcagaaaacttgaggccaaagaggtttccaaggtccgtgcctaggcaaacctctgggcacctggtggtcaaacactggatgcttctgcctgctaataggggacctgtaggaggatctgtccagcctggcccccgtcatctttcccatcccaacccccggaggctgatcagggaggtgaaactatgtgtactccacagatgagctcattgcttgaggcaacagagaacttctcaaagtaaacgagaatgaagtatattcgcagccacagcagccaaaaccggctcttacctatccacgccatctactggcttgtgggtcaaactgcaagcccaatataaaacctattgacagaagtgcatagggctgcagaggcaaagtgaaaagacccctacccagcactctctacagtcacacccctctaggaggcaggtacagggaaagggaaacaactaatattatagagaaagtaagaaaaaaatcttacctgcatgaaaataattacaaaatttataagtgctagtatctttggattagaaggaaccagtgaaagaatactgacaccacgaaaaacgtcaaagtgatgacaccagaggatcatactggctctccagcaatgatccctaaccataatagaaactcagaaatgaatataaagaattcagtgcatggattgcaaggaaattcaacaatatccaagacaaggttgaaaatcaacgcaaagaaacttctaaagcaatgcaggtaaggaagaaaagataaacatcttgaaaagaaatcagtcagaacttatagaaggagaaacctcactaaaagaatttcaaaatacaattgaaagctttatctaaggactggaccgagcaaaataaataactttagagcttgaagaccagtcttccaaaataacccagtcagacaaaaataaaggaaaaaaggaattttaaaaagtgaacaaagtctttgagaaatatgggaatgtgtaaagtgacaacatatgaattactggcattcctgagagagagaacaaatagtaaatagccaggaaaacctatttgagggaataataccagaaaatttctctttttttagagaagtagacatcctgacacaagaaataaatatggcatctgtgacatactatacaaaatgaacatcaccaaggcatatagtcacaagactgtccaaggtcaatgttaaagactaatctttaaaaagaaaagattaaatcacatacaaagggaactacatcaggctaatagcagactttttatcagaatccttgctaaccaagagagattggaggcttattttaagcatttttaaagaaaggaaattccactcaagaatttcatattccactaatataagcttcgtaagcaaaggtgaaataaaacctttttccaaacaagcaataactaagagaatttattataacaccagccttacaaaagatctttaagggaattctaaacattaaagtgaaagaatgatacctgctaacacaaaaacatacttgattacctatcccacagaccttataaaataaccacacaatggaagctacaaaggaaacatctaacaactccatggtaggaagaaaacctcacatataaatactaaccttgaaactaaacagtgtaaacaccccacttaagaggcatagttccaagttgagtaaaaaacaagacctctccatctgctgttttcaagagacttatctcacacataatgccactcattggatcaaagtaaaggtttggagaaacagctatctcacaaatggacatttaaaaagaccatgggtcactatgcttatactgaacacaatagactttacaccaaaaactgcaaaaaaagacaaagaacagcattacatattgatgaaagttcaattcaacatgaagaccccatacttaaatgagatagttaacctatttagagcatccaccattagagcaacaccattgataaaacaagtactttgagacttagggaaagactaagatatccacgtaataatagtgggaaacttcaaaccccactgagagcattaggtagatcatctaggtagaaaactaaaaactgagttttggaaagaaaatttacacttgaccaattggacctacctaataaacagcaaataataataaacctaataaacagaacccttcacccatcaaccacagaatatataatcttctcatctacacatggaacatactacaaggttggactcatgctcagccacaaatcaagtgtcaataagctgaaaaagaaaaagaaaatcatatcacttgtactgtcagatcacagtggaataaaaacagaaattaataccaagaagatctccccaagccccacaattacataggaattgaacaacttgctcttgaatgacttttggcaaagcaacaaaattaaggtagaaatacaaaaatctttgaaatcgatgaaaacagagacacaatatactgaaatttctgggatgcagcaaaagcaatttaatggggaacgtatatattgcactaaacacctatctcagaagttagaaagatctcaaattaataatatcatacctagaggaactatataaacaagaacaaactaacaccaaacattggttctttgaaaggatgaacaatattgaatgaccactagctagattaacaaaaacaaaacaaaaagaagtttcaaatatgcacaatcagaaacaatggtaacgttacaactcatcccacagatacagattatcagagacttttattaataactctatgcacacaaactagaaagtctagaggaaatggataaatctctgtaagcacataacctctgaagattgaatcagggaaaaattgaatttctgaatagagctatatcaaattgcaaaattgaatcattaatgaaaaacataccaatccataaaagccttgaagcaggtagatttgcagtcaaattctaccagatacacaaagagctgttagtatttctattcaagctattctaaaaaattgaggaggaaatactcctccctaagtcattcaaggaaaccagcattaccctgacactaaagcctgcaaacacataacaaaaagaacaaactacagaacaatgtccttgatgccataacaatcttcaacaaaataatgtcaaaccaaatctaatagcacatgaaaaagttaatttaccacgatcagttagcctttattcctgggatgatgcaagggtggttcaacatatgcaaatcaataaatgtgattaaccatgtgaacagaattaaaacaaaaatcatatgatcatcttaatagatgcataaaagtgtttgatggaatatcccttcatgataaaaattctcaacaaactaggtatcaaatgaacatacatcaaaataattagatatgtcggtgacaaacccacagacaacatcatactgaatgggcaaatgctagaagcattccccttaacaataggaacaagacaaggatgcccactctcaccactcctattcaatatagtgctagaagacttaaccagagcaatcaggtaagagaaagaaataaaagacatccaaataggaaaataataagttaaatatctctcttcactacatttgaaaaaaacaaaaaactattctaaaatttatatggaagaaataacagagcccaactagccaaagcaatcctaaacaaaaagaacaaagttgcctgggcatgatggctcatgactgtaatcccagcactttgggaggctgaagcaggtggatcatgaggtcaggagttcgagaccagcctggccaacatggtgaaaccccgtgtctactaaaaatacaaaaattagctgggcgtggtggcacacacctgtaatcctaactactcaggaggctgaggcaggagaattgcttgaacctgggaggcagaggttgcagtgagctgagatcacgccactgcacaccagcctgggcaagagagcaaaactctgtctcaggaaaaaaaaaaaaaaagaacaaagttggagagatcatattacctgacttcagactatactagaaggctacagtaaccaaaacgtcatggtgtttgtacaaaaacagaaacataaacaaatgcaacagaataaagaacccagaaataaagctgcacacctacagccatctgatcttcgacaaagttgacaaaaataaacagtggagaatggaattcctattttaatggtgctgcgatagctggctagccatatgcagagaactgaaaccagacttttttagtaacagccattctgactagagtgagatatctcattgtggttttaatatgcatttatctgattattagtaatgtggaccatttttttcatataccttttgcccattattgtttcttcttttgaaaacatatctattcatgtgtgttgcccactttctaatggaatcatttgtttcatcttgttgatgttcttgaattgagtttcttgtatatgtggatactagtccaaaggttacttctttatttatgcaactataatgcacagtgaagcattagtattcttaggtttttatttgtacagtccttgaggggtttgagagtacaactttaaaagtgcacaaaattcatcatgatactggtcataataaacacacatcaagtgtgttagcacactatcattagactgtagcaatcctaaacatctgtaacaattttgtaacataaagcataactagaaaacttatttcaaagatctcttagtatatatgactgaagtttctcagccatggatgatactagttttgaatcaaacacttaaattagtttattatgcctcctcttatgtccaggtaaaattagaatgtccaagaatacacatttctttggactgaggagtttttcagaacacagatttttggtgctaagccatgaaagttccattaaaaaggggaaaagttgttaacatgagttacatggtttctagtttctataaatccagaaatgactgtcccctcctcacccactgttaaatacatgtagacttgggcaggaatacaggactttttttgatgtttgatgtacttttgatttcaaagcaattaaatctgaataaagagaacatcaaagggcagattaagtctcttaaaatatttctgaatattgtggggattttctgagcagcctgcttcagaaattctaaaatgtgatgaatgagcaatctagtctcatgctctggaagcctttgaagacttgaggaccaaatagtgggaatagaaatgagcaactttgatcaatgtcaagggacacttctcccctaaaacacacatacaaaggaccacttaattgtacattctagtagctttccttcgacatgatattttgttagcaacttttccttctcacagaaactattacttatactcttgattttttttattatcagcatcagttggcctagcattcaaagaaaggagtagatgctgactaaatatttactagtggatacaaaatagatcacatattgatggtcataaagaagatatgaaacagaaatttcccttctatatatattatattcattaatgtatttgagtcacactggaacaagaaggcacacattatatcaaacatggaggagagatttaattttgtattttattttctattctaagcttactaggacatactactattcactatcttgactaaataattatacttcctgaatcatattacatcagaactttggtgaacaacaatgacataggaattaatagtagacatgaaggtgagtgaattaaataaaaggttattactatattcttataaagtaattaattaaatttttagcattttgttttgttaagattttacatatgatttttttaacatgctactttataatttcattttttaaagcattaagttttaaacatctttgtacatcattaaatattcttttacataaatatttttaggtaactacatagatattcattttataaaattatcatgatttttaaaacatttttcattgctggacctatgggtcatttttatttttattactataataaagaataccgcaaataaaacatttagattttcatgctaattgttgtcttatatagctttctatatataaagccgaggaaccaaataatgcacaaatgtttctggttttgttaaatgggcattcaaacatactatacaaacttactctcccaagtatattgtgcaacagtaccataatataaatgatcattaattatccataatttgtgtaagcttcattttttcttcttacgttagaatggaaaataaagcatattgtatattgatttagctagtgtatcaaggctgttttactagaacaatacatcatgatcatactttctttttgactactttagggattatatttagtttcattcttataaaaatttatagcttaatgaataaatgaacaatgaggtaatgttcttcaaagcatgtccagttttatatcatgattcatcacatataagaactgctatagaaaagataatgctattctagaattgcatatatgacaggttgatttatctttgcattctgtgtgttttgatgtacagactttttaatggcattcattcattaatttcacagggcatgcctcctatatgtatgacaccatagtggttctagaggtatataaaatgaataaaatacagactctgcccttaaggagtttaaaaactagtaggggagagacatgaaaataaatagccatgatacagaatgaaatgttaagtgcccccagagaggtgaaagcatactccaggaaaatgctgatagatgcaattgcttctacagaaggtaaccaggtaaattgacattggttgggactttaaatattgaatagtgttttattctttttcagaacagtcattgttttggcacttttaaaaataatgaaaggcaaatcatatttccatatatgataagtaacactaaaatactcacatttcttaaaatgtcaataatggaagggatctcaaagatcatctagtcctatatgttattaatatcaagacatgaataaaatattttggaaattgaagtatgcttacaacaaaacctcaactatccataatcatgtaataattctgtaagagttctaaccttgacaaatacatttgtctgcttcctagtctatttgttctgggcagcaacttgactttttacagttcatttggagagaaatctttagcaaactacttgggatccttgatttggttaaagctagaggaaattgtggctgaaaaaagaaaaaaaaaaaagacttaataggccaggcgcggtggctcatgcctgtaatcccagcattttgggaggcagaggcaggcagattgcctgaggtcaggagttcgagaccagtctggccagtatggtgaaaccctgtctctactaaaaattaaaaaaaaaaaattagctgagtgtggtggcatgcacctgtaatcccagctactcaggagactgaggcaggggaattgcttgaaccagggaggtggaggttgcagtgagccaagattgcaccactgcactccagcctaggcgccagaatgagactctgtctcaacaaaaaaaaaaaaaaaaaaaaaagaagacttaatatactttcagatgattgtattatctttattgataattaatatttaagttacaataaatttattgattttctttttattggagagtattttcaattgaaaatcagaatattgggatttagtttttattgtttaaataattactagtttgaacttaggaaagtctttagacttttcttgacatatattttctcacccaattatttccaatcccttttaactatatctaaaatatttgctttttttctttgtaaaatcgtgaacaaaatacatatatgatattgatactactagatagaaaggctgtgaagttggctgttggaaactctcatgctcagttctcattacatcaaccatttcaattgtttcagtacatgattttataagacctttctcccactttcccagtgattacggcatcctacaagttattatttttgtcttccatttctatttaatacactggtaaaattctaagccaaaatttaactgttagttcaaactactttttaagggtataattttatgctttatttgccctttaaataaagctacataattgctctagagagaataagaatgcatgtgggatataatataacatgtaccttttctgaacaaggaaaaaaagttgtgcaaattgaagctgtaattactacgtgcaggcgtaaagaaaaaatgattttctagtcactgtattcattcaccttgagtaggaaattatagtttttctaatttaaaaaggtcactttatttttctgagcatttgattggttgaatatcacacacttttactttttgcatgaattgggctgtttgggggttactgtctagaaaatgttgagacatttatttaaatgcagagtatattattgattccagactgtcaactcaaggctaaaatcctgcttgaaacatgagaagtggataaccatgtgcacatgactagtacctaccccatgacagtttcttaagaaccctgtagtagaattaaattatcagaggttatggaaacggctgcttgtgtctagtgagtatcacactggaaggtcattattgaggcagccataatttttattcacaatacacacacaaccaatagtgccaagataattcaagactgaacatcccatccacacaccaacctgtagattcctgccagttcatgcaagtcagggaattaccaaaaataaattttaaaaattagagtatattccagtggatttaattttgaatgaattttttgtcaaaattttcactttatctatcttctatcctttaaaaattgttttgttctgttaaaattgaatttacatatttattgaaaatatttacattatgtattttttactataagtactcttcaatatagttcaaaatatttatttttctgaattatttattaattttaattgacatataaaattatttatctttattgtacacaggacgatgttctgaaatatgtgtacactatgaaatggcttcatatccagtaaatggtcttgatactaaattcagaccaatacaaaaccataacaggaaactattgaccaatatccccaatgaacataaatgctaaatttctcaacaaaatacgagcaaactgaacccaacagcacttccaaaagatgatacactatgatcaagtgggttttataccagggatgcaaggatggttcaataatgcaaatcaataaatgtgatgcaccacataaacagaattaaagacaaaaactatataatcccaatagatacataaagttgataaaattcagcacttattcatcataaaaaatccctcaacaaactggcatagaaataataaagaccatatatggcgaactcacagccaaaatcatactgaaaggtgaaagttgaaagcattccctttagaagctgaaacaagacaaggatgctcatttgcatcgctcctattaagcatagtattgaaagtcctatccagaagaatcaggcaaggaaaagaaataaaacgtatccaaattggaaaacagggcctcaaattatccctgttcactgatgatatggtcttatatcttgaaaaccctaaccattccaccaaaaacctcctagattttgatgaatgaattagtaaagtttcagcatacaaaatgaacatgcaaaatcagtagtatttctatacaccaacaacaatctagctggagcactaaatcaagaatgcaatgcaatttacaatagatgcaaaaataataacaaggaatatatttaaccaagaggaaaactacaaaacactgatgaaagaagtagtaaatgacacaaatgaaaaataatcacatgctcatggatcagaagaactaatatctttaaaatgaccacaatgcccaaagcaatccacagatttaatgtgattgctatcattatactaacatcacatttcacagaagtagaaaaataatcctaaaatgtatatggagccagaaaaggactcagatatccaaagcaaaactaagcataaagcaggctggagacatcacattacctgatataaaattgtactacaaagttacagtaaccaaaaccgcattgtgctggtacaaaaatagatatatagatcaatggaacagaatagagaaaccagaaatagggccacatacttatagtcagctgaagtttgaacaaagtcaacaagaacacacactggggaaaggacaacattttcaataatgatgctgggaaaaatggatttctatatgcagaaaaataaaatgaggcctctgtctttcatcatatacaacaatcaactaagatgtattttaaataattaaatatatgacctaagactataaattaccagaagaaatctagagaaaattattttgaacattggtccaggcaaggaatacagaaccaagacctcaaatgcacaggcaatgaaaacaaaaataaatggaatttaattaaactaaaaatcttttgtgcagcaaataaataatcaacagggtaaagagacaatcctcagaatgggaaaaaatacttgcaaactattcatccaatagaagactaatatccagaatatgcaaggatctcatacaagtcaacaacaacaacaacaaaagaatcccattaaaaaatggtctaaggacacggtaggaatttgtttttaaaaaaagtcacaaaagtccgacaagaatatgaaaaaaagtttgtatcatcactaatcattagtgaaatagaaattaaaaccacagtgaaatatcatcttacccagtaagaatggctattcttaaacagaaaaaataacagtggttagtgaggacgtggagaaaagaaagcacttatacactgttagtggaagagtaaattagtacaacatctatggaaaatttttggagattttgcaaagaactaaaaatagaactaaattcaatcaagcaatcacacaactagctatctatctaaaggaaaataaatcattatataaaaagacaactgcatctacatagttattgtaggactattcacaattgcgaagatatggaaccaatctaagtgcccatcaaatgatgagtgggcaaaggatacacaatgaaacactattcagccataaaaatgaaattatgtcttttgcagcaacatagatgaaactggaagtcattattttaattgaaatacacacagagacaacacgttatcacttataattgagagcttagtaatgtgtacacatacaggtagtatgtgaaataacagacagtggagacttagaagagggtgggtgatgagaaattacttaatgtctataatgtatgctaatcgctgatagacactaaaagccccgacttcaatgctttgcaatatatcaatataacaaaataatacttgtacctcataaagttatacaaatcaaataaaattttaaataagattactgagatcaacataatggagctttactcctaaattttcttctagtagttttaaagtttctggtcttacattcaagtcttgcaattgattttgagttgacttttttatatggcgtgaagtaaggtccgattttattcttttgcatgtagatgtccagttatttcacatttttgaacattctgtccttttcccgtgcatccttggcacttttacaaaaattaattgaccattgatgtgtagctttatcttttggctttatattctgttctattggttaatgtgtctgtttttattggggggaagaggatattttttgccaataccatgttgttttgattataattgctttgtaatacattttgaaatcaatgatatggtttgactatgttcctacccaagtctcatcttgaactgtagttccaataatctccacgtgttctgtaaaggacccagtgggaggtaattggataataggggtggatacctctatgctggtctcatgatagtgagttctcatgcaatctgatgtttttataagaggatttccccccattcccttggcacttctcattgctgctgctatgtaaagaaggacgtgtttgcttacccttctgccaagagtgtaagtttcctgaggcctccccagtcatgctgaactgtggtcaattaaacctctttcctttataaattacccagtctctggtatgtctttaatagcagcatcagaatgaactaatatagtaaattggcaccatgtgtgggggtgctgttgtaaagatacccaaaaatgtgaagtgattttggaagtgggtaataggcagaggtaggaacagtttggagggctcagaagaagacgtgaaaatgtgggaaaggttggaatttcctagagacttgttgaatggctttgaccaaaatgctgatattaatatggacaataagtccagggtgaggtagtctcagatggaggtgaggaacttgttgggaactggagcaaaggtgactcttgttatgctttagcaaagagactgtcagcatttagcccctgccctagagaggtgtggaactgtaaacttgagagatgatttaaggtacctggcagaagaaatttctatgttttctcgttgttcaattccaaagcattcaagagctgacagaacataaaagtttggaaaatttgcagcctgatgatgcaatagaaaagaaaaacccattttctaaggataaattcaagcctgctgcagaaatttgcataagtaatgaggaggcaaatattaattgccaagacaatggggaaaatgtctccagggaatgtcagagaccttcacagcagcccttcccatcacaagcctcaaggccttggagaaaaaacatggtttcctgggctgggtccaggcactcctgctgtgtgcagcctggagaattggtgtcctgtgtcctagctagtccagctatggctaaaaagggtcaagttacagctggggctatggcttcagagggtgtaagccccaagccttggcagcttccacttggtgtttgtcctgtgggtacagagaagagaagaattgaggcttgagaacctccacctagatttcaaaggatggatgggaaggcctggatgtccaagcaggggtatgctgcaaaaggcagaacactcttttgagaacttctactagggcagtgcgaaagggaaatttggctttggacccccacagagtgtccccactgggacactgccagctgtgagaaaagggccagcctcctccagactccagaacggtagatccactgtcagcttgcaccatgagtcgggaaaagctgcagacagtcaatgtcagccatgaaagcagccatgagaggagttgtaccctgcaaaactacatggtcagagctgcccaaagtcctaggagcccacctcttgcatcagcatgtcctggatgtgagatatggagtcaatggagatcattttggaacttaaggtttaatgactgccctattggattttggacttgcatggggcctgtagctcctttattttggccaatttctcccatttggaatgggtgtattcacccaatgcctgtattctcattgtgtctggaaagtaactaacttgcttttgattttacaggctcataggcagaaatgacctacttttctcagatgagactttggatttggacttttgagttaatgctggaatgagctaagactttgggggactgttggaagggcatgattgtgttttaaattgtgaggacataagatttcaaagggtccgagggcagaatgatatagtatagctgtgtcccctccaaaatctcatcttgaactgtggttctccacatattgtgggagagacctggtgggaggtaattgaaacatgggggcggttacctccatgctgttctcatgatagtgagggagttttcatgagatctgatggttttataaggggctttccccccacttcacttggcacatctccttgctgctgtgatgtaaagaagaacatgtttgcatccccttccaccatgattgtaagtttcctgaggcctcccaagccatggtgaatcatgagccaattaaacttattttctttataaatcacccagtctcaggtatgtcttcattagcagtgtgagaacagacaaatacagtcagggagtgtgatgcctttaggttttttcatttttactctagactgctttggctattctggctttttttttggttacataacaattttaggatttttgtttctattcatgtggaaaaaaagattattgaaatatttatagtaaatgctttaaatctgtatatcactttggtatggacattttaacaatattaattcttctcatcctggaacactaaattttttctgtctatttatatatttggaaatgtccttcattaatgttttctagttttgggtgtacagttctttctcctccttggataaatttagtcagaagtattttattttacatgttgtagtcatcacaaatgtttcttttttaaatttctttttcagatactttgttgtcatcatatataaatactactgatttttgtatatttattttgtaccttacaactttactaaatttgttgactggttctgacagttttattgtgtagtcttcagagttttttaaatatgggattctgtcatctgcagatacaaacaatataacttctttcctaattttgataccatttattcattttgttcttgcctgtttgctctaggtagaagttgcagtatcctcttaataagtagtagcaggagtacactttgtcttgttccatattttagatgaaaagctatcaacttttcccttttgagtgtgatgatattagctgtgggtttattatgtatggcttttattgtgttgaggtacttctttttatacttatgttgtttgaagcttttatcaggaaaatatgatacattttattaaatgctttttctgtatctattgagatgttcacatggttttgttcttcatcattcccttaatgtggtgtattacacttattaccttgcatatattgtcgcatccttgcatcgcagggacaagtcccacttgaaaatgattaataatttttaattgtgctgttgaattatgttgtattacagtctacctctcccttcatagttatctattaatatttctttaatatatttgggagctccaattttggattatatatatatatatttataaatgatatattcccttgattaaccccattaacataatataatgaatgaccttctcctcctttcttatagttttggacttcaaatctgttttatctgatataaatatagctattcctgctctctttttgtcttcatttgtacagattattttttccattccttcactttcagtctatgtgcttcccttaacggtggcatatagttgggtcttggctgcattattattattttttaattgattaagttattccttaccttttgattgcataatttaatccatttacattcatggtaattattaattgataaggaattactattttcttgtttatttcagcttgaacaactctctgtagcatttctcgtaaagaaggtctgatggtaatggaccccctcagcttttatttgtctgaaaaagcctttattttccatttctaaataacatttttatttatagtatgcttactttgcagttctatttccctcaacacgttgactacatcatttcattctttcctggcatgtggtatttctactgagaaatctgctgatagccttattggaactcccttacatttgatttatttcttttctcttgctgatttcagaatcttctctttatttttaatttttgatggcttaattatattatgccttggtgtagtcttatttggagttaatctgattaaagatgtttgatttctagccttcttggaactcttcttaaaattgattttttctttcttttctcttgctgctttcaggatcttcctttatctttacttcttgatgatttgattataatatgccttgacgtagtcttatttggagttaatctgattagagatcttggattttcctctagatggatatttttatattttctcatatttgaaaagcattctgctattgtttttaaaaataatctaatactttgctgctctcttcttctttttctattttttaacattatttgaattttattttatttatttattttattttattttattattattatactttaagttctagggtaaatgtgcacaatgtgcaagttagttacatgtgcatacatgtgccatgctggtgtgctgcacccattaactcgtcatttagcattaggtatatctgctaatgctatccctcccccctccccccaccccacaacagtctccagagtgtgatgttccccttcctgtgtccaggtgttctcattgttcaattcccacctatgagtgagaacatgcagtgcttggttttttgtccttgagatagtttactgagaatgatgatttccaatttcatccatgtccctacaaaggacatgaactcatcattttttatggctgcatagtattccatggtggatatgtgccacattttcttaatgcagtctatcattgttggacatttgggttggttccaagtctttgctattgtgattcgtgccacaataaacatacatgtgcatgtgtctttatagcagcatgatttatagtcctttgggtatatacccagtaatgggatggctgggtcaaatggtatttctaattctagatccctgaggaatcgccacactgactgccacaatggttgaactagtttacagtcccaccaacagtgtaaaagtgttcctatgtctccacatcctctccagcacctgttgtttcctgactttttaatgatcgccattctaactggtgtgagatggtatctcattgtggttttgatttgcatttctctgatggccagtgatgatgagcactttttcatgtgttttttggctgcataaatgtcttcttttgcgaagtgtcttttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttgtgttgccattgcttttggtgttttagacatgaagtccttccccatgcctatgtcctgaatggtaatgcctaggttttcttctagggtttttatggttttaggtctaacgtttaagcctttaatccatagcttaccaaccaaaaatgaatccagatggattcacagccgaattctaccagaggtaaaaggaggaactggtaccattccttctgaaactattccaatcaatagaaaaagagagaatcctccctaactcattttatgaggccagcatcatcctgataccaaagccgggcagagacacaaccaaaaaagacaattttagaccaatatccttgatgaacattgatgcaaaaatcctcaataaaatactggcaaaccaaatccagcagcacatcaaaaagtttattcaccatgatcaagtgggtttcatccctgggatgcaaggctggttcaatatacacaaatcaataaatgtaatccggcatataaacagaagcaaagacaaaagccacatgattatctcaatagatgcagaaaaggcctttgacaaaattcaacaatgcttcatgctaaaaactctcaataaattaggtattgatgggacgtatctcaaaataataagagctatctatgacaaacccacagccaatatcatactgaatgggcaaaaactggaagaattccctttgaaaactggcacaagacagggatgccctctctcaccactcctattcaacatagtgttggaagttctggccagggcaattaggcaggagaaggaaataaagggtattcgattaggaaaagaggaagtcaaattgtccctgtttgcagatgacatgattgtatatctagaaaaccccattgtctcagcccaaaatctccttaagctgataagcagcttcagcaaagtctcaggatacaaaatcaatgtacaaaaatcacaggcattcttatacaccaataacagacaaacagagagccaaatcatgagtggactcccattcacaattgtttcaaagagaataaaatacctaggaatccaacttacaagggacgtgaaggacctcttcaaggagaactacaaaccactgctcaacaaaataaaagaggatacaaagaaatggaagatcattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaagaaagctggaggcatcacgttacctgacttcaaactatactacaaggctatagtaaccaaaacagcatggtactggtaccaaaacagagatatagatcaatggaacagaacagagccctcagaaataatgccgcatatttacaacatctgatctttgacaaacctgagaaaaacaagcaatggggaaaggattccctatttaataaatggtgctgggaaaactggctagccatatgtagaaagctgaaactggatcccttccttacatcttatgctctcttcctcttaaactcatataactctaataatttcttttgtgatgctgttccatacattctttattctctctttattctatttcattgttttcctcctctgactgtgtattttcaaataaactgtcattgagttcacagatttctttgtgtgtgtgtgtaaaaaattatattgtttatgctctctattttattttattcattgtattttataggtccataattgcattatttatttattttaatagccttaggagtacaagtggcttttcattacatggatgaatttgttagtggttgtgatggttaatattgagtatcaacttgattggattgaaggatgcaaagtactgatcctgggtgtgtctgtgagagtattgccaaaggagattaacatttgagccagtgggctggggaaggcagacccacacttaatctggtgggcaaaatataatcagctgccagcaaatacaaagcaggcagaaaaacgtgaagcggagagaatggcctagcctcccagccttcatctttcccccatgctggatgcttcctgccctaaaacatcggactctaggtactttggttttgagactcagactggctctccttgctcctcaagcttacagacagtgtattgtgttaccttgtgatcatgtaagttaatacttaataaacttctcatatatagatatagatatcctatatacctatctctctatctatctatagatatctatatctatctatatctatgtatctatctgtctatgtgtctatctatctatctatctatctatctatctatctatctatctacctatcctattagttctgaccctctagggaaccctgactaatacagtggtgaagtctgggatttgagtgaacattgtacgtaatatgcagttttttatctttcacctcctttccagccttcccacttctgattgttcagtgtccagtataccaatctgtatgcctttgtgtaaccataacttagataccatttataagtgagaatatgtagtattgggtttttaatttctgagacacttcacttagaataatggcttgtagttccatcaaaattgctacaatatacattattttattctttcttatgactgagtaggattccatggtgtgtgtgtatgtgtttgtgtgtgtgtaatcaaaaaacaataact

SEQ ID NO: 884 - DNA, 10591 bp, Homo sapiens
gataaaggctgagggccgcgcgcttggcccagaccggcccggccagcgcgcattcggccccggacgaaggtactcgcagcacttggagcgcagaaccggccgcgcccggtgagtgtggaggggggggacctgcgggccgaggaagggtgcccactctagatggctcaggatgcccgcacttttctttgttcttgggacaggagggatcggggagcctccggtcctgggaagccccccggggtgcggggtgggaggggctccgcgcagccagcgccgccctggccggacctcagcccccgccccgccccccggggcactcccccttcaccgcgggtgaccttgaactggttgccgttccgccctccgttgcccagccacacggtcccagtctcccgactacagtctttcgttcccgatcggggttcctcccccgcgcgcagcccagtcgtcttcctcccctgccaggggcagcgcggcgccccctccccgggactccgggcggcgctcccaggcgggcccggcagagggcgcgcccgagctgctgactcaccgcatccccgagcgcgcgcgggcgcagccggggacgccgcgtcacgtcacggctcgagcgggcgcgcctcggggaaacgggttctgcccgcggccggcgggtgggcgcgcggggcccccggcggcagccacccggccacgtcaccgaggtgcgggcgccccgccccggccacaactccgcccccacgcaccacgccctccccggggccgcggccctagcctcaccgtcgcccgcccgccccgggaccccggccacgaggcgcggacttcgcgctcccgcttccgctcgcggcttttcccggacgaaggcggcggggtggccccacgacttcctgcccctcccggcgccgggaacaatggcccgcgccccctcccgctcccggccgctcccttgggatcgcgaggggtaccagacccgtctccagacctgggtcccgcgccccccggggcgcgcccgccctttgttgcgggctccgggcgcttatgaatggctgcgggcgcgggcggggcgggggcgggcgcggagaggcgccagccccgcccccgctgcgctccccttggtcgcctgggcgctgggggcggggcgagggggcgggcccggctgccacgtggggcggtgccgcggcggctctcataggcccgggctcgcggccgactgggcgctcggcgcgcggcgattggccggcgcccggccggcggagtaagtagtgaatgggagggggcggcggccccgccccctggaacgttgatacattataacttttttttcttgttactttcacccccagatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacgtaggtaccgcgcgcccccggccggccgccccctcgggccccggcccccgggcgggaacaaagagcgcgccgcgcggggaaggcagggggcggccagacagggggcgggggcgcgccgcgcgctctcgggcgccctctgctcggcctcgcctgcctcggccccctcccccgcccggggtcgccgcacaaaggcggctgcgagggcgtcccgggccgggcttcggcggccccccttgggggcgggcaggaatcccagggcgttgcgggggtcccggctgcgggtgtgggggccgccaccgccccctcccgcctgcgtccgcgccggcttccgcatctgctcggcggcctcctctgcgtctggctgtctccccccacttgcgtctctctccccccctttgttctcgcctccgagcgctccccgcagcctcccctcccccctggtatttaaatcgcctgcaggcccggagccctccccccgcgggcctccggggacacgcagtgtccatcccagtggaggggcccatcgggggaggggcggagggggagggtctcctttgtctgcgcggcggcggccgcctgcgccggggagggaggaggagggggagcccggcccggcgcaacccccagggcctctcctcgggccgaaacccgtggttcctacaaagaggagccaggactagaattagggaattgggggcaggggctgccctggggtcgtgggggaaggtggcatagagcacactggggcccagaggaggagaaagtgcctggttggggtgcagagggggtgccagagtccagggcgggggttccactggagggaaggggtccgaatcgccaggatggggctcccagcaccagacggagacctctctgcacgcgcttagggccctggatctggaagccgggaaggggtgggggtgggaacttatccgtctctccccacacaagcacagccctcccccgcggcctctgcttccgcgtccctgtgtcgtctccgcggagtctcatgctcttccttcctccccccagccggctcagttcggggaagctgcaggagttcggcgtgggtgatggcagcaagctgaccttggtacccaccgtggaagcgggcctcatggtaaatggccatggggctgcgtgcccccagaggcccccgcacacaggcagtagcccctccctcggtacctgtccgcacacacactacctggggcccccaccccgccagccagcagggccctctccaccccctattccagcccaggattccgaccccacactcaggcccctctcctccctctctttgtagtctcaggcctcaaggccggaacagtccgtgatgcaagctctcgagagtctcacggagacgcaggtaagacctcgccagccccttcctaacagggcagccctgggagcagggtgccttggccaccgacggggcctgggggttgtctgtgctcccaggaggctgggggaggggaggggacgcgccaccccgcctgggtgccagcctggcctggcctccccacctcctctcccccaagattcaccacctgacccggagggctttctctcccacggtggctgccctgggggaagggggcctggctttcacaagactgcctgcaggatgaccttggcctatggggcctcatccccgctcacaccctggcctgcatccccagccccctccgcccccaccgaggagcccccctccagccgctgtggcttccccagagcgagtttctccttttttacatttctgctgagggctgggggtggcggcttgggtgacactccttccgccttccgtgacccccatcgtgagagggtggggatctcgtcaccctcccctcctctctctggcctttgttctctaccccgaaaggggagggggcgggggtgcccagccctggggccagtgaggcctagacaggatgttaggaaaatatttagtaagcggccaggagggaggctggggctggccctcacccggttcccggttttgctgcggacttttttttttttttctccttctttcctcattttcttggctgcggccaagccttcctcagacaagggccctggccacctcccaggagggtgacacaggcctcagcaatccgcccgctgccagggtgggggacgcaggctgccacccgccccagcaaggggtggccggcttcccgggcctccctggccccgaggcccgcacccccttccgctttcccagcggcatgtagagtcctgccctttccctacatcgcgggggcagggcgggggccgggagctgggtggtctgccatgggggtggccacagcagcagcagcagtggcgtgggggcagagccggggtcccgagccagggcgggggctgcaggtgatttcctggggcgagtgtgagcagagctccccgccgctggggggctgcggttggcagggggcccagggcgtgttggcttcacaccctcctccctgggcgcctgcgtcaggaaggagctgggttggggggggctggagggggtgctgggcggagacactgggctccccagggttgcttccctgcctggcaccgagtcatgcccgcccattagccttccccagggaggaagttgcagggcgggtggtggtggggactccagctgctctcgggaagccaccccgggcccttcctgcaaaggctgtcttggggcaggggggtagggggccgggcaggctgggccgcagggtgggggcttcaccctgccctcctccctgcctccctccccatgggccccaagcagagaaggttacgccagctactgccagtggagaggagagccgggagggagagctgggaggcggtcggttctgagtcatcccagcctatgtcacttctcagaaacctccgccacccccccccccatcccggccactggggagagcagggctctggcccatacccagagcagggggcttggcgaggacagggtgagattcaacccacacccaccctgaacgggggcagattgagggtttctgtgcttggagcaggttgtgccctccgggactccagccccagggcggtcagggccccttcctgcagccttgccacagccccctaggcctccgccccgcccaggacagataaatatttatcttgagaaagcaaaggttaggacagaagaattcgtgcaggaattccacccacttgctggccctggtgacttagctgggagggggcctgaggtggagcccctcccgtatccacaggcagagaggatctaggggcccatgagggtgggggaaaggcaaagtgaaggttgtttgaggtcagtgactgccagctgggccccgccccctctggcctcagtttccccttgcaagaccgacctagttggccagggaggggcaggcccccgtctgacccgcctctgtccccacagcccccagcggcgcccgggccgggccgggctggcggaggaggcttccggaaatacagattcattttatttaagcgtccgtggcaccgacagggaccccagagcccagagaggggcggcgagaggccccaggtcacagcgcggggggactgggccgggctgggctgggggcgccgcaagctggggctcccagctgacggaccgctctccttgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggaggtgagcctggggaagggaagggtgacccttggttggaatccaaagggtgggccgtcctggggaggtcttggggaggacaaggactcttagtcccaggtgagtcccttgtattaagggctatcctgtgacctcgggctggtgggtgatcccccagcctagattggtggggtatttctagatcctgagttgacggtcatcgcctgacatgacctggaccagtagatgatctcttgatctttgactcatgggtcatctctgtgtcctgggttggttgtgacctcgtgaccttgggctagtttatctctaaaccctgtgttgacaggtcatctcctgacctgggctggtgggtgatctctggtccctgggttgctggtgatcccctgatcctggaccccgtgctcatgtgccccttcctcccatcagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggtaggtgtcacagcacatgtgtgagctcacgtgtgtcccgtgaccctgtgcatttggggtctacatccacccacaggcgactccacatattctgggcatacacaggctgtgtccgtctgctcacttcacatgtcccccaggaatcccccacacacacgcctggccctgcccggggggccgcgggtcaccaggcgcctgcatactggggacgtgtcccgctcccgccccgtggtccctcgtgcacatcagcccacatgtccacgccattgcctgagctcatgagctcacacccgtggacgcccgtcctggacatgcgggactgtgcccgtgccgggcactcacggccacctctgcccgcaggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggtgagtggccaccctcgggggtcctaccttccccgcccgcctgggcttctcaaggcccctctgtgtgagctggtgggctcaggagcagctgacctgcccaggggctgggggggatggcagctgccgtggccactgctctgctccagcccggagagaaggcagcatgtgtgtcagggcacaaagtgtccttgtgtgctcccggggggccacaggcccacttcctcctgccccacccccacccggggcatcatctccagatggcatttggtgcctctgtgaatggccaagtcaggcctggcaggccgaggcggggccagagcccacccctaagcatttcagtgacttggaaaagcagcgaacacaacccccctgccagcctggccccagctactcccaaacggcgggttactccctccagagtctcaccagaagatggctactgtactgcccttgggctctgcacccgtcgcgggggctcctcccagctcagtttaaaagtgggaaactggccgggcgcggtggctcacgcctgtaatcccagcactttgggaggccgacgcgggcggatcacgaggtcaggagatcgagaccatcttggctaacatggtgaaactccgtttccactaaaaatacaaaaaattagccaggcgtggtggtgggcgcctgtagtcccagctactcgggaggctgagacaggagaatggcgtgaacccagaggcggagcttgcagtgagccgagatcgcgccactgcactccagcctgggcgacagagcgagactccgtctcaaaaaaaaaaaaaaaaaaccaaggtacaacccccaagtatctcccctcggatcacagaagcggccaagccccctccatgtaggactccaggaagaatgaggcaggacagtcctgacctccccagctcatggctgagctggagaattagaagccagctgcgtagctgggactccaggcaaacaccaccatgcccagctaattttgtaatttttgtagaggaggggtctcgctctgtggctcaggcctgtctcgaactcctgaggttgcccaggcctgtctcgaactcctgagctcaagcgattctcctgcctcggcctcccaaagtgctgagattacaggcgtgaaccactgtgcccggcatggtggatgtccttgactgtttcctttgctgacctccctccagggagggcaggactgtgtctgacctcaggggcatttgctggggtctggggtggtcctctgtgttcagcaggtggaggctttgggagtcacaggccactacctcctttgcaggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaacaca
